(12) United States Patent
Dai et al.

(10) Patent No.: US 7,171,311 B2
(45) Date of Patent: Jan. 30, 2007

(54) METHODS OF ASSIGNING TREATMENT TO BREAST CANCER PATIENTS

(75) Inventors: Hongyue Dai, Bothell, WA (US); Yudong He, Kirkland, WA (US); Peter S. Linsley, Seattle, WA (US); Mao Mao, Kirkland, WA (US); Christopher J. Roberts, Seattle, WA (US); Laura Johanna Van't Veer, Amsterdam (NL); Marc J. Van de Vijver, Amsterdam (NL); Rene Bernards, Abcoude (NL); A. A. M. Hart, Castricum (NL)

(73) Assignees: Rosetta Inpharmatics LLC, Seattle, WA (US); Netherlands Cancer Institute, Amsterdam (NL)

( * ) Notice: Subject to any disclaimer, the term of this patent is extended or adjusted under 35 U.S.C. 154(b) by 317 days.

(21) Appl. No.: 10/342,887

(22) Filed: Jan. 15, 2003

(65) Prior Publication Data

US 2004/0058340 A1 Mar. 25, 2004

Related U.S. Application Data

(63) Continuation-in-part of application No. 10/172,118, filed on Jun. 14, 2002.

(60) Provisional application No. 60/380,710, filed on May 14, 2002, provisional application No. 60/298,918, filed on Jun. 18, 2001.

(51) Int. Cl.
*G01N 33/48* (2006.01)
*C12Q 1/68* (2006.01)

(52) U.S. Cl. .............................. 702/19; 702/20; 702/23; 435/6; 435/600

(58) Field of Classification Search ...................... None
See application file for complete search history.

(56) References Cited

U.S. PATENT DOCUMENTS

| | | | |
|---|---|---|---|
| 5,510,270 A | 4/1996 | Fodor et al. | |
| 5,539,083 A | 7/1996 | Cook et al. | |
| 5,545,522 A | 8/1996 | Van Gelder et al. | |
| 5,556,752 A | 9/1996 | Lockhart et al. | |
| 5,578,832 A | 11/1996 | Trulson et al. | |
| 5,677,125 A | 10/1997 | Holt et al. | |
| 5,716,785 A | 2/1998 | Van Gelder et al. | |
| 5,891,636 A | 4/1999 | Van Gelder et al. | |
| 6,028,189 A | 2/2000 | Blanchard | |
| 6,057,105 A | 5/2000 | Hoon et al. | |
| 6,107,034 A | 8/2000 | Wiegel | |
| 6,271,002 B1 | 8/2001 | Linsley et al. | |
| 6,342,483 B1 | 1/2002 | Holt et al. | |
| 6,342,491 B1 | 1/2002 | Dey et al. | |
| 6,358,682 B1 | 3/2002 | Jaffee et al. | |
| 6,432,707 B1 | 8/2002 | Reed et al. | |
| 6,455,300 B1 | 9/2002 | Htun et al. | |
| 6,647,341 B1 | 11/2003 | Golub et al. | |
| 2003/0086934 A1 | 5/2003 | Botstein et al. | |
| 2003/0215805 A1 | 11/2003 | Lillie et al. | |
| 2003/0224374 A1 | 12/2003 | Dai et al. | |
| 2005/0048542 A1 | 3/2005 | Baker | |

FOREIGN PATENT DOCUMENTS

| | | |
|---|---|---|
| WO | WO98/33450 | 8/1998 |
| WO | WO00/55173 | 9/2000 |
| WO | WO01/05935 | 1/2001 |
| WO | WO01/06013 | 1/2001 |
| WO | WO01/46697 | 6/2001 |
| WO | WO01/51628 | 7/2001 |
| WO | WO02/16650 | 2/2002 |
| WO | WO02/18646 | 3/2002 |
| WO | WO02/085298 | 10/2002 |
| WO | PCT/US05/07894 | 3/2005 |
| WO | PCT/US05/27243 | 8/2005 |

OTHER PUBLICATIONS

Merriam-Webster On-line, printed from < http://www.m-w.com/cgi-bin/dictionary> on Oct. 17, 2005. One page for the word "patient" and one page for the word "individual".*

GeneCards, printed from <http://genecards.bcgsc.bc.ca/cgi-bin/carddisp?DC13> on Oct. 17, 2005. See printout of 5 pages.*

(Continued)

*Primary Examiner*—John S. Brusca
*Assistant Examiner*—Shobo (Joe) Zhou
(74) *Attorney, Agent, or Firm*—Jones Day

(57) ABSTRACT

The present invention relates to genetic markers whose expression is correlated with breast cancer. Specifically, the invention provides sets of markers whose expression patterns can be used to differentiate clinical conditions associated with breast cancer, such as the presence or absence of the estrogen receptor ESR1, and BRCA1 and sporadic tumors, and to provide information on the likelihood of tumor distant metastases within five years of initial diagnosis. The invention relates to methods of using these markers to distinguish these conditions. The invention also provides methods of classifying and treating patients based on prognosis. The invention also relates to kits containing ready-to-use microarrays and computer software for data analysis using the diagnostic, prognostic and statistical methods disclosed herein.

33 Claims, 46 Drawing Sheets

OTHER PUBLICATIONS

Figure 1:
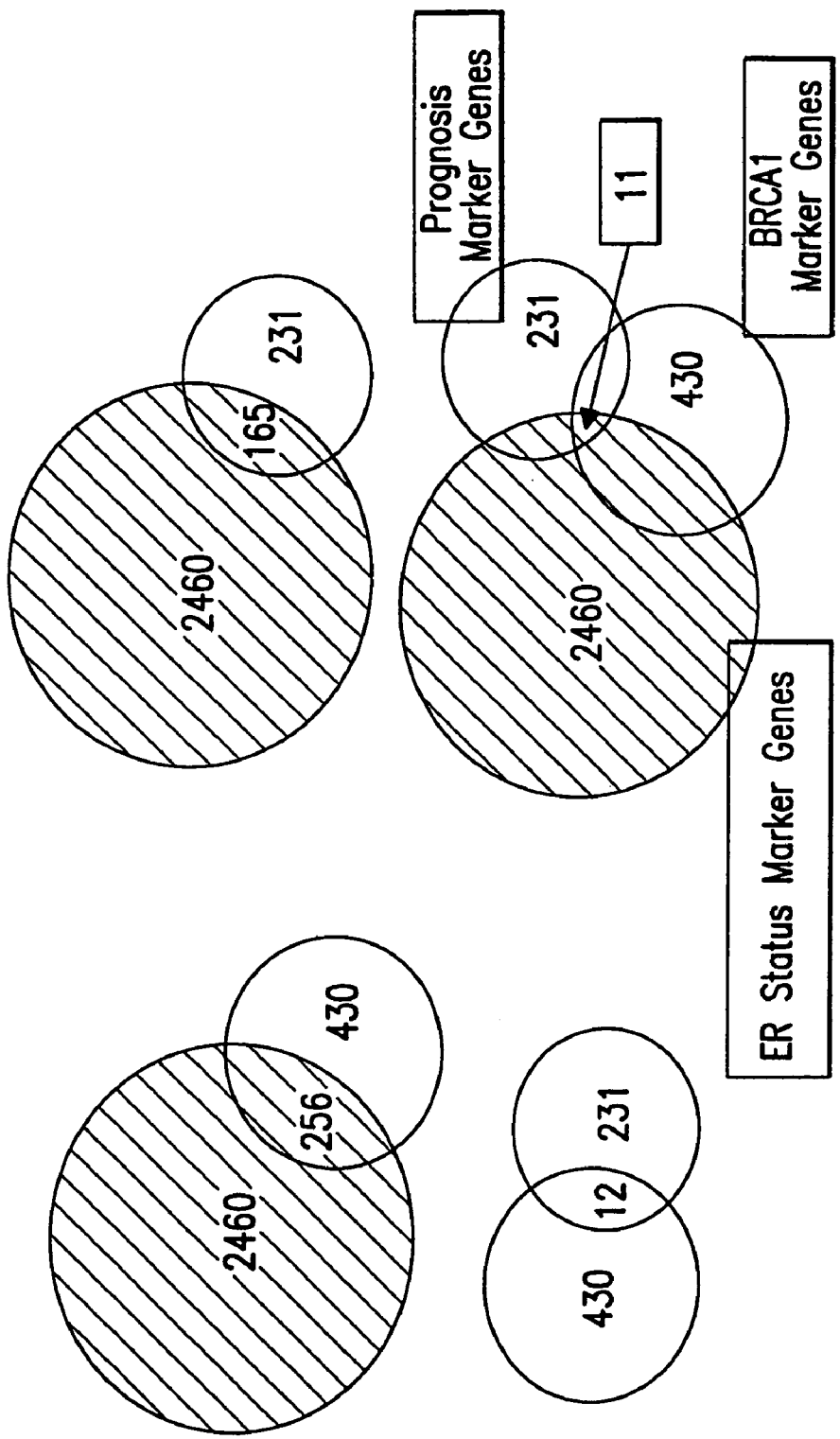

Beenken et al., 2001, "Molecurlar Biomarkers for Breast Cancer Prognosis: Coexpression of c-erbB-2 and p53", Annals of Surgery 233:630-638.
Blanchard et al., 1996, "High-Density oligonucleotide arrays", Biosensors and Bioelectronics 11:687-690.
Bonaldo et al., 1996, "Normalization and Subtraction: Two Approaches to Facilitate Gene Discovery", Genome Research 6:791-806.
Casey et al., 1997, "The BRCA1 and BRCA2 breast cancer genes", Curr Opin Oncol, 9:88-93.
Chappuis et al., 2000, "Clinico-pathological charateristics of BRCA1-and BRCA2-related breast cancer", Semin Surg Oncol, 18:287-295.
Chirgwin et al., 1979, "Isolation of biologically active ribonucleic acid from sources enriched in ribonuclease", Biochemistry 18:5294-5299.
Chu KC et al., 1996, "Recent trends in U.S. breast cancer incidence, survival, and mortality rates", J Natl Cancer Inst, 88:1571-1579.
DeRisi et al., 1996 "Use of a cDNA microarray to analyse gene expression patterns in human cancer", Nature Genetics 14:457-460.
Egholm et al., 1993, "PNA hybridizes to complementary oligonucleotides obeying the Watson-Crick hydrogen-bonding rules", Nature 365:566-568.
Ewing et al., 2000, "Analysis of expressed sequence tags indicates 35,000 human genes", Nature Genetics 25:232-234.
Ferguson et al., 1996, "A fiber-optic DNA biosensor microarray for the analysis of gene expression", Nature Biotechnology 14:1681-1684.
Fodor et al., 1991, "Light-directed, spatially addressable parallel chemical synthesis", Science 251:767-773.
Froehler et al., 1986, "Synthesis of DNA via deoxynucleoside H-phosphonate intermediates", Nucleic Acids Research 14:5399-5407.
Hughes et al., 2000, "Functional discovery via a compendium of expression profiles", Cell, 102:109-126.
Hughes et al., 2001, "Expression profiling using microarrays fabricated by an ink-jet oligonucleotide synthesizer", Nature Biotechnology 19:342-347.
Jatoi et al., 1998, "Breast Cancer Screening", The American Journal of Surgery 177:518-524.
Kononen et al., 1998, "Tissue microarrays for high-throughput molecular profiling of tumor specimens", Nature Medicine 4:844-847.
Laird et al., 1999 "Deficiency of Conexin 43 Gap Junctions Is an Independend Maker for Breast Tumors." Cancer Research 59:4104-4110.
Lander, 1996, "The new genomics: Global views of biology", Science 274:536-539.
Lockhart et al., 1996, "Expression monitoring by hybridization to high density oligonucleotide arrays", Nature Biotechnology 14:1675-1680.
Lukas et al., 2001, "Alternative and aberrant messenger RNA splicing of the mdm2 oncogene in invasive breast cancer", Cancer Res, 61:3212-3219.
Marcus et al., 1996, "Hereditary breast cancer: pathobiology, prognosis, and BRCA1 and BRCA2 gene linkage", Cancer, 77:697-709.
Maskos and Southern, 1992, "Oligonucleotide hybridizations on glass supports: a novel linker for oligonucleotide synthesis and hybridisation properties of oligonucleotides synthesised in situ", Nucleic Acids Research 20:1679-1684.
McBride et al., 1983, "An investigation of several deoxynucleoside phosphoramidites useful for synthesizing deoxyoligonucleotides", Tetrahedron Letters 24:245-248.
Miki et al., 1994, "A strong candidate for the breast and ovarian cancer susceptibility gene BRCA1", Science, 266:66-71.
Nguyen et al., 1995, "Differential gene expression in the Murine Thymus Assayed by quantitative hybridization of arrayed cDNA clones", Genomics 29:207-216.
Parker et al., 1997, "Cancer statistics, 1997", CA Cancer J Clin, 47:5-27.

Pease et al., 1994, "Light-generated oligonucleotide arrays for rapid DNA sequence analysis", Proc. Natl. Acad. Sci. USA 91:5002-5026.
Rudolph et al., 2001, "Concurrent Overexpression of p53 and c-erbB-2 correlates with accelerated cycling and concomitant poor prognosis in node-negative breast cancer", Human Pathology 32:311-319.
Sagliocco et al, 1996, "Identification of proteins of the yeast protein map using genetically manipulated strains and peptide-mass fingerprinting", Yeast 12:1519-1533.
Schena et al., 1995 "Quantitative monitoring of gene expression patterns with a complementary DNA microarray", Science 270:467-470.
Schena et al., 1996, "Parallel human genome analysis; microarray-based expression of 1000 genes", Proc. Natl. Acad. Sci. USA 93:10614-10619.
Shalon et al., 1996, "A DNA microarray system for analyzing complex DNA samples using two-color fluorescent probe hybridization", Genome Research 6:639-645.
Shevchenko et al., 1996, "Linking genome and proteome by mass spectrometry: large-scale identification of yaest proteins from two dimensional gels", Proc. Natl. Acad. Sci. U.S.A 93:10869.
Sorlie et al. (2001) "Gene Expression Patterns of Breast Carcinomas Distinguish Tumor Subclasses with Clinical Implications." PNAS. 98:4104-4110.
S-PLUS 2000 Guide to Statistics., MathSoft, vol. 2. Chapter 3:p. 43-66, May 1999.
Perou et al., "Molecular Portraits of Human Breast Tumors," Nature, vol. 406, Aug. 17, 2000, www.nature.com, pp. 747-752.
Li et al., "Role of Transforming Growth Factor beta 3 in Lymphatic Metastasis in Breast Center. Int. J. Cancer," 1998, vol. 79, pp. 455-459.
Luparello et al., "Tissue Inhibitor Metalloprotease (TIMP)-1 and Proliferative behavious of Clonal Breast Cancer Cell," Breast Cancer Research and Treatment, 1999, vol. 54, pp. 235-244.
Van Hul et al., "Identification of a Third EXT-like Gene (EXTL3) Belonging to the EXT Gene Family, Genomics," 1998, vol. 47, pp. 230-237.
Singhal et al., "Elevated Deoxycytidine and Thymidine Kinase Activites in Human Breast Carcinoma Cells: Inhibition by Difluorodeoxycytidine and Azidodeoxythymidine, " Proceedings of the International Cancer Congress, 16th, New Delhi, Oct. 1994, vol. 2.
Akiyama et al., GenBank Accession No. NM_020386 (Nov. 5, 2002).
Altieri, D.C., GenBank Accession No. NM_001168 (Oct. 31, 2000).
Amid et al., GenBank Accession No. NM_020974 (Dec. 3, 2002).
Andersson et al., GenBank Accession No. AF052159 (Aug. 5, 1998).
Andersson et al., GenBank Accession No. AF052162 (Aug. 5, 1998).
Andersson et al., GenBank Accession No. AF055033 (Apr. 5, 1998).
Andrulis et al., GenBank Accession No. NM_001673 (Oct. 31, 2000).
Ansorge et al., GenBank Accession No. NM_018410 (May 14, 2002).
Auffray et al., GenBank Accession No. AL355708 (May 10, 2000).
Austin et al., GenBank Accession No. NM_006681 (Dec. 23, 2002).
Bamshad et al., GenBank Accession No. NM_016569 (Aug. 4, 2001).
Belluoccio et al., GenBank Accession No. AJ224741 (Sep. 22, 1998).
Bennett et al., GenBank Accession No. NM_004603 (Nov. 5, 2002).
Bloecker et al., GenBank Accession No. AL133603 (Feb. 18, 2000).
Blum et al., GenBank Accession No. AL080079 (Feb. 18, 2000).
Blum et al., GenBank Accession No. AL133619 (Feb. 18, 2000).
Blum et al., GenBank Accession No. AL137718 (Feb. 18, 2000).
Boyd et al., GenBank Accession No. NM_004052 (May 7, 1999).
Bradshaw et al., GenBank Accession No. NM_003258 (Oct. 31, 2000).

Cadena et al., GenBank Accession No. NM_003676 (May 16, 2002).
Campbell et al., GenBank Accession No. NM_000849 (Oct. 31, 2000).
Cenciarelli et al., GenBank Accession No. NM_012177 (Jun. 15, 2001).
Chang et al., GenBank Accession No. NM_000286 (Nov. 5, 2002).
Chen et al., GenBank Accession No. NM_002916 (Nov. 5, 2002).
Chen et al., GenBank Accession No. NM_004163 (May 14, 2002).
Chen et al., GenBank Accession No. NM_006101 (Oct. 4, 2002).
Cheung et al., GenBank Accession No. NM_016448 (Jun. 14, 2001).
Chottiner et al., GenBank Accession No. NM_000788 (Oct. 31, 2000).
Cook et al., GenBank Accession No. NM_000127 (Jan. 15, 2003).
Creasy et al., GenBank Accession No. NM_006281 (Feb. 10, 2002).
Dahl et al., GenBank Accession No. NM_000320 (Jan. 15, 2003).
Dhar et al., GenBank Accession No. NM_014321 (Nov. 5, 2002).
Ding et al., GenBank Accession No. AF148505 (Oct. 31, 1999).
Duesterhoeft et al., GenBank Accession No. AL080059 (Feb. 18, 2000).
Fletcher et al., GenBank Accession No. NM_006763 (Nov. 2, 2000).
Fong et al., GenBank Accession No. NM_002073 (Nov. 5, 2002).
Fritz et al., GenBank Accession No. NM_004504 (May 7, 1999).
Frye, GenBank Accession No. NM_016539 (Feb. 6, 2003).
Geisbrecht et al., GenBank Accession No. NM_006117 (Nov. 5, 2002).
Gu et al., GenBank Accession No. NM_020188 (Dec. 23, 2002).
Hennenberry et al., GenBank Accession No. NM_020244 (Jan. 22, 2002).
Heyer et al., GenBank Accession No. NM_014791 (Apr. 7, 2003).
Hirosawa et al., GenBank Accession No. AB032973 (Nov. 11, 1999).
Hirosawa et al., GenBank Accession No. AB033007 (Nov. 11, 1999).
Hirosawa et al., GenBank Accession No. NM_012429 (Feb. 13, 2003).
Hirst et al., GenBank Accession No. NM_003875 (Nov. 1, 2000).
Holthoff et al., GenBank Accession No. NM_005915 (Aug. 27, 2002).
Hostikka et al., GenBank Accession No. X05610 (Jul. 13, 1995).
Hu et al., GenBank Accession No. NM_003748 (Apr. 10, 2002).
Huang et al., GenBank Accession No. NM_004911 (Nov. 1, 2000).
Ikeda et al., GenBank Accession No. NM_006115 (Jun. 19, 2001).
Isogai et al., GenBank Accession No. NM_015434 (Nov. 2, 2000).
Isogai et al., GenBank Accession No. NM_018004 (Dec. 23, 2002).
Isogai et al., GenBank Accession No. NM_018098 (Jun. 21, 2002).
Isogai et al., GenBank Accession No. NM_018120 (May 14, 2002).
Isogai et al., GenBank Accession No. NM_018136 (Sep. 30, 2002).
Isogai et al., GenBank Accession No. NM_018265 (Dec. 23, 2002).
Isogai et al., GenBank Accession No. NM_018354 (Nov. 5, 2002).
Isogai et al., GenBank Accession No. NM_019013 (May 14, 2002).
Jiang et al., GenBank Accession No. NM_003981 (Dec. 10, 2001).
Kassovska-Bratinova et al., GenBank Accession No. NM_000436 (Oct. 31, 2000).
Kawakami et al., GenBank Accession No. AK000745 (Feb. 22, 2000).
Kawakami et al., GenBank Accession No. NM_017779 (May 15, 2002).
Kayano et al., GenBank Accession No. NM_006931 (Nov. 2, 2000).
Kiefer et al., GenBank Accession No. L27560 (Jun. 27, 1994).
Kiefer et al., GenBank Accession No. NM_000599 (Oct. 31, 2000).
Kiefer et al., GenBank Accession No. NM_002570 (Oct. 31, 2000).
Kim et al., GenBank Accession No. NM_004701 (May 7, 1999).
Kimura et al., GenBank Accession No. NM_003158 (Oct. 31, 2000).
Kimura et al., GenBank Accession No. NM_003600 (Nov. 4, 2002).
Koehrer et al. GenBank Accession No. AL080110 (Feb. 18, 2000).
Koehrer et al., GenBank Accession No. AL137295 (Feb. 18, 2000).
Koehrer et al., GenBank Accession No. NM_015416 (May 14, 2002).
Kokame et al., GenBank Accession No. NM_006096 (Jan. 19, 2002).
Krane et al., GenBank Accession No. M21551 (Jan. 7, 1995).
Kuge et al., GenBank Accession No. NM_014754 (Mar. 31, 2001).
Lai et al., GenBank Accession No. NM_015984 (Nov. 12, 2002).
Laporte et al., GenBank Accession No. US58033 (Jun. 20, 1996).
Lassalle et al., GenBank Accession No. NM_007036 (Feb. 8, 2001).
Lauper et al., GenBank Accession No. NM_004702 (Aug. 21, 2001).
Leung et al., GenBank Accession No. NM_003376 (Nov. 1, 2000).
Li et al., GenBank Accession No. AF201951 (Jan. 24, 2000).
Li et al., GenBank Accession No. NM_002358 (Sep. 30, 1999).
Meyerson et al., GenBank Accession No. NM_006201 (Nov. 1, 2000).
Michelson et al., GenBank Accession No. NM_000291 (Oct. 31, 2000).
Mochizuki et al., GenBank Accession No. NM_013296 (May 14, 2002).
Mzhavia et al., GenBank Accession No. NM_014889 (Dec. 23, 2002).
Mzhavia et al., GenBank Accession No. NM_014968 (Dec. 23, 2002).
Nagase et al., GenBank Accession No. AB020689 (Jun. 16, 1999).
Nagase et al., GenBank Accession No. AB033043 (Nov. 11, 1999).
Nagase et al., GenBank Accession No. AB037745 (Mar. 14, 2000).
Nagase et al., GenBank Accession No. AB037863 (Mar. 14, 2000).
Nagase et al., GenBank Accession No. NM_014363 (Nov. 2, 2000).
Nagase et al., GenBank Accession No. NM_018104 (Dec. 10, 2001)
Nagata et al., GenBank Accession No. NM_004358 (Nov. 1, 2000).
Naito et al., GenBank Accession No. NM_000017 (May 3, 2002).
Nakagawa et al., GenBank Accession No. NM_014875 (Oct. 20, 2002).
Nishiyama et al., GenBank Accession No. NM_001280 (Dec. 19, 2001).
Nomura et al., GenBank Accession No. NM_006265 (Apr. 4, 2002).
Nomura et al., GenBank Accession No. NM_014750 (Apr. 10, 2002).
Nussbaum, R.L., GenBank Accession No. U45975 (Jun. 29, 1996).
Obata et al., GenBank Accession No. NM_020166 (Nov. 2, 2000).
Ohbayashi et al., GenBank Accession No. NM_003862 (Jan. 17, 2003).
Ohta et al., GenBank Accession No. NM_016337 (Jan. 13, 2003).
Olsson et al., GenBank Accession No. NM_013262 (May 4, 2000).
Opdam et al., GenBank Accession No. NM_016577 (Dec. 23, 2002).
Ottenwaelder et al., GenBank Accession No. AL137502 (Feb. 18, 2000).
Ottenwaelder et al., GenBank Accession No. AL137514 (Feb. 18, 2000).
Pangilinan et al., GenBank Accession No. NM_004336 (Nov. 5, 2002).
Pastorek et al., GenBank Accession No. NM_001216 (Jan. 17, 2003).
Pennica et al., GenBank Accession No. NM_003882 (Nov. 1, 2000).
Ponnambalam et al., GenBank Accession No. NM_001282 (Feb. 3, 2001).
Qing et al., GenBank Accession No. NM_013437 (Nov. 2, 2000).
Rattner et al., GenBank Accession No. NM_005196 (Feb. 3, 2001).
Redmond et al., GenBank Accession No. NM_002900 (Dec. 20, 2001).
Renner et al., GenBank Accession No. X94232 (Aug. 26, 1997).
Richardson et al., GenBank Accession No. NM_001827 (Jan. 15, 2003).
Romano et al., GenBank Accession No. NM_000224 (Nov. 5, 2002).
Ruiz-Perez et al., GenBank Accession No. NM_018401 (Dec. 10, 2001).

Santamarina et al., GenBank Accession No. NM_001333 (Oct. 31, 2000).
Satoh et al., GenBank Accession No. NM_002019 (Oct. 31, 2000).
Scanlan et al., GenBank Accession No. AF155117 (Jan. 5, 2000).
Scharf et al., GenBank Accession No. AF073519 (Jul. 12, 1999).
Schmiesing et al., GenBank Accession No. NM_005496 (Dec. 19, 2001).
Schneider et al., GenBank Accession No. NM_003234 (Oct. 31, 2000).
Schuetze, N., GenBank Accession No. NM_007203 (Apr. 4, 2002).
Simpson et al., GenBank Accession No. D25328 (Feb. 11, 2003).
Sobel et al., GenBank Accession No. NM_005563 (Nov. 1, 2000).
Solomon et al., GenBank Accession No. NM_000507 (Oct. 31, 2000).
Song et al., GenBank Accession No. NM_002808 (Apr. 15, 2002).
Stavrides et al., GenBank Accession No. NM_012261 (Nov. 5, 2002).
Strausberg, R., GenBank Accession No. AA555029 (Aug. 14, 1997).
Strausberg, R., GenBank Accession No. NM_004456 (Jun. 10, 2002).
Strausberg, R., GenBank Accession No. NM_006372 (Jun. 10, 2002).
Strausberg, R., GenBank Accession No. NM_020675 (Jun. 3, 2002).
Sullivan et al., GenBank Accession No. NM_001809 (Mar. 19, 1999).
Suzuki et al., GenBank Accession No. NM_014078 (Jul. 6, 2001).
ten Dijke et al., GenBank Accession No. NM_003239 (October 31, 2000).
Thon et al., GenBank Accession No. NM_000158 (Jan. 15, 2003).
Tsurmi et al., GenBank Accession No. NM_002811 (Oct. 31, 2000).
van Heyningen et al., GenBank Accession No. NM_001124 (Jan. 15, 2003).
Wambutt et al., GenBank Accession No. AL050021 (Feb. 18, 2000).
Wambutt et al., GenBank Accession No. AL050090 (Feb. 18, 2000).
Wang et al., GenBank Accession No. AF257175 (Jul. 17, 2002).
Wendler et al., GenBank Accession No. NM_003662 (Dec. 23, 2002).
Wiemann et al., GenBank Accession No. NM_015417 (Jan. 19, 2002).
Wiles et al., GenBank Accession No. NM_001007 (Oct. 31, 2000).
Wilhelm et al., GenBank Accession No. NM_004994 (Jan. 15, 2003).
Wilke et al., GenBank Accession No. NM_005342 (Nov. 5, 2002).
Wilson, R.K., GenBank Accession No. R70506 (Jun. 1, 1995).
Yamauchi et al., GenBank Accession No. NM_001905 (Nov. 5, 2002).
Yamazaki et al., GenBank Accession No. NM_004798 (Nov. 5, 2002).
Yanagidani et al., GenBank Accession No. NM_04480 (Feb. 2, 2002).
Yang et al., GenBank Accession No. NM_000096 (Oct. 31, 2000).
Yao et al., GenBank Accession No. NM_003878 (Jan. 15, 2003).
Yasugi et al., GenBank Accession No. U96131 (Jul. 26, 1997).
Yin et al., GenBank Accession No. U82987 (Sep. 26, 2001).
Yoshida et al., GenBank Accession No. NM_012214 (Nov. 2, 2000).
Zhang et al., GenBank Accession No. AF161553 (May 22, 2001).
Zhang et al., GenBank Accession No. NM_014109 (Oct. 1, 2002).
Zhao et al., GenBank Accession No. NM_003607 (Dec. 30, 2002).
Zhao et al., GenBank Accession No. NM_018454 (Dec. 10, 2001).
Zhao et al., GenBank Accession No. NM_018455 (Feb. 10, 2002).
Contig753—Mar. 17, 2000—http://www.phrap.org/green_group/est_assembly/index.html.
Contig1778—Mar. 17, 2000—http://www.phrap.org/green_group/est_assembly/index.html.
Contig2399—Mar. 17, 2000—http://www.phrap.org/green_group/est_assembly/index.html.
Contig2504—Mar. 17, 2000—http://www.phrap.org/green_group/est_assembly/index.html.
Contig3902—Mar. 17, 2000—http://www.phrap.org/green_group/est_assembly/index.html.
Contig4595—Mar. 17, 2000—http://www.phrap.org/green_group/est_assembly/index.html.
Contig8581—Mar. 17, 2000—http://www.phrap.org/green_group/est_assembly/index.html.
Contig13480—Mar. 17, 2000—http://www.phrap.org/green_group/est_assembly/index.html.
Contig17359—Mar. 17, 2000—http://www.phrap.org/green_group/est_assembly/index.html.
Contig20217—Mar. 17, 2000—http://www.phrap.org/green_group/est_assembly/index.html.
Contig21812—Mar. 17, 2000—http://www.phrap.org/green_group/est_assembly/index.html.
Contig24252—Mar. 17, 2000—http://www.phrap.org/green_group/est_assembly/index.html.
Contig25055—Mar. 17, 2000—http://www.phrap.org/green_group/est_assembly/index.html.
Contig25343—Mar. 17, 2000—http://www.phrap.org/green_group/est_assembly/index.html.
Contig25991—Mar. 17, 2000—http://www.phrap.org/green_group/est_assembly/index.html.
Contig27312—Mar. 17, 2000—http://www.phrap.org/green_group/est_assembly/index.html.
Contig28552—Mar. 17, 2000—http://www.phrap.org/green_group/est_assembly/index.html.
Contig32125—Mar. 17, 2000—http://www.phrap.org/green_group/est_assembly/index.html.
Contig32185—Mar. 17, 2000—http://www.phrap.org/green_group/est_assembly/index.html.
Contig33814—Mar. 17, 2000—http://www.phrap.org/green_group/est_assembly/index.html.
Contig34634—Mar. 17, 2000—http://www.phrap.org/green_group/est_assembly/index.html.
Contig35251—Mar. 17, 2000—http://www.phrap.org/green_group/est_assembly/index.html.
Contig37063—Mar. 17, 2000—http://www.phrap.org/green_group/est_assembly/index.html.
Contig37598—Mar. 17, 2000—http://www.phrap.org/green_group/est_assembly/index.html.
Contig38288—Mar. 17, 2000—http://www.phrap.org/green_group/est_assembly/index.html.
Contig40128—Mar. 17, 2000—http://www.phrap.org/green_group/est_assembly/index.html.
Contig40831—Mar. 17, 2000—http://www.phrap.org/green_group/est_assembly/index.html.
Contig41413—Mar. 17, 2000—http://www.phrap.org/green_group/est_assembly/index.html.
Contig41887—Mar. 17, 2000—http://www.phrap.org/green_group/est_assembly/index.html.
Contig42421—Mar. 17, 2000—http://www.phrap.org/green_group/est_assembly/index.html.
Contig43747—Mar. 17, 2000—http://www.phrap.org/green_group/est_assembly/index.html.
Contig44064—Mar. 17, 2000—http://www.phrap.org/green_group/est_assembly/index.html.
Contig44289—Mar. 17, 2000—http://www.phrap.org/green_group/est_assembly/index.html.
Contig44799—Mar. 17, 2000—http://www.phrap.org/green_group/est_assembly/index.html.
Contig45347—Mar. 17, 2000—http://www.phrap.org/green_group/est_assembly/index.html.
Contig45816—Mar. 17, 2000—http://www.phrap.org/green_group/est_assembly/index.html.
Contig46218—Mar. 17, 2000—http://www.phrap.org/green_group/est_assembly/index.html.
Contig46223—Mar. 17, 2000—http://www.phrap.org/green_group/est_assembly/index.html.
Contig46653—Mar. 17, 2000—http://www.phrap.org/green_group/est_assembly/index.html.
Contig46802—Mar. 17, 2000—http://www.phrap.org/green_group/est_assembly/index.html.

Contig47405—Mar. 17, 2000—http://www.phrap.org/green_group/est_assembly/index.html.
Contig48328—Mar. 17, 2000—http://www.phrap.org/green_group/est_assembly/index.html.
Contig49670—Mar. 17, 2000—http://www.phrap.org/green_group/est_assembly/index.html.
Contig50106—Mar. 17, 2000—http://www.phrap.org/green_group/est_assembly/index.html.
Contig50410—Mar. 17, 2000—http://www.phrap.org/green_group/est_assembly/index.html.
Contig50802—Mar. 17, 2000—http://www.phrap.org/green_group/est_assembly/index.html.
Contig51464—Mar. 17, 2000—http://www.phrap.org/green_group/est_assembly/index.html.
Contig51519—Mar. 17, 2000—http://www.phrap.org/green_group/est_assembly/index.html.
Contig51749—Mar. 17, 2000—http://www.phrap.org/green_group/est_assembly/index.html.
Contig51963—Mar. 17, 2000—http://www.phrap.org/green_group/est_assembly/index.html.
Contig53226—Mar. 17, 2000—http://www.phrap.org/green_group/est_assembly/index.html.
Contig53268—Mar. 17, 2000—http://www.phrap.org/green_group/est_assembly/index.html.
Contig53646—Mar. 17, 2000—http://www.phrap.org/green_group/est_assembly/index.html.
Contig53742—Mar. 17, 2000—http://www.phrap.org/green_group/est_assembly/index.html.
Contig55188—Mar. 17, 2000—http://www.phrap.org/green_group/est_assembly/index.html.
Contig55313—Mar. 17, 2000—http://www.phrap.org/green_group/est_assembly/index.html.
Contig55377—Mar. 17, 2000—http://www.phrap.org/green_group/est_assembly/index.html.
Contig55725—Mar. 17, 2000—http://www.phrap.org/green_group/est_assembly/index.html.
Contig55813—Mar. 17, 2000—http://www.phrap.org/green_group/est_assembly/index.html.
Contig55829—Mar. 17, 2000—http://www.phrap.org/green_group/est_assembly/index.html.
Contig56457—Mar. 17, 2000—http://www.phrap.org/green_group/est_assembly/index.html.
Contig57595—Mar. 17, 2000—http://www.phrap.org/green_group/est_assembly/index.html.
Contig57864—Mar. 17, 2000—http://www.phrap.org/green_group/est_assembly/index.html.
Contig58368—Mar. 17, 2000—http://www.phrap.org/green_group/est_assembly/index.html.
Contig60864—Mar. 17, 2000—http://www.phrap.org/green_group/est_assembly/index.html.
Contig63102—Mar. 17, 2000—http://www.phrap.org/green_group/est_assembly/index.html.
Contig63649—Mar. 17, 2000—http://www.phrap.org/green_group/est_assembly/index.html.
Contig64688—Mar. 17, 2000—http://www.phrap.org/green_group/est_assembly/index.html.

* cited by examiner

METHODS OF ASSIGNING TREATMENT TO BREAST CANCER PATIENTS

This application is a continuation-in-part of U.S. application Ser. No. 10/172,118, filed Jun. 14, 2002, which in turn claims benefit of both U.S. Provisional Application No. 60/298,918 filed Jun. 18, 2001 and U.S. Provisional Application No. 60/380,710 filed May 14, 2002, each of which is incorporated by reference herein in its entirety.

This application includes a Sequence Listing submitted on compact disc, recorded on two compact discs, including one duplicate, containing Filename 9301188999.txt, of size 6,480 kb, created Jan. 13, 2003. The sequence listing on the compact discs is incorporated by reference herein in its entirety.

1. FIELD OF THE INVENTION

The present invention relates to the identification of marker genes useful in the diagnosis and prognosis of breast cancer. More particularly, the invention relates to the identification of a set of marker genes associated with breast cancer, a set of marker genes 5differentially expressed in estrogen receptor (+) versus estrogen receptor (−) tumors, a set of marker genes differentially expressed in BRCA1 versus sporadic tumors, and a set of marker genes differentially expressed in sporadic tumors from patients with good clinical prognosis (i.e., metastasis- or disease-free in at least 5 years of follow-up time since diagnosis) versus patients with poor clinical prognosis (i.e., metastasis or disease occurred within 5 years since diagnosis). For each of the marker sets above, the invention further relates to methods of distinguishing the breast cancer-related conditions. The invention further provides methods for determining the course of treatment of a patient with breast cancer.

2. BACKGROUND OF THE INVENTION

The increased number of cancer cases reported in the United States, and, indeed, around the world, is a major concern. Currently there are only a handful of treatments available for specific types of cancer, and these provide no guarantee of success. In order to be most effective, these treatments require not only an early detection of the malignancy, but a reliable assessment of the severity of the malignancy.

The incidence of breast cancer, a leading cause of death in women, has been gradually increasing in the United States over the last thirty years. Its cumulative risk is relatively high; 1 in 8 women are expected to develop some type of breast cancer by age 85 in the United States. In fact, breast cancer is the most common cancer in women and the second most common cause of cancer death in the United States. In 1997, it was estimated that 181,000 new cases were reported in the U.S., and that 44,000 people would die of breast cancer (Parker et al., *CA Cancer J. Clin.* 47:5–27 (1997); Chu et al., *J. Nat. Cancer Inst.* 88:1571–1579 (1996)). While mechanism of tumorigenesis for most breast carcinomas is largely unknown, there are genetic factors that can predispose some women to developing breast cancer (Miki et al., *Science*, 266:66–71(1994)). The discovery and characterization of BRCA1 and BRCA2 has recently expanded our knowledge of genetic factors which can contribute to familial breast cancer. Germ-line mutations within these two loci are associated with a 50 to 85% lifetime risk of breast and/or ovarian cancer (Casey, *Curr. Opin. Oncol.* 9:88–93 (1997); Marcus et al., *Cancer* 77:697–709 (1996)). Only about 5% to 10% of breast cancers are associated with breast cancer susceptibility genes, BRCA1 and BRCA2. The cumulative lifetime risk of breast cancer for women who carry the mutant BRCA1 is predicted to be approximately 92%, while the cumulative lifetime risk for the non-carrier majority is estimated to be approximately 10%. BRCA1 is a tumor suppressor gene that is involved in DNA repair anc cell cycle control, which are both important for the maintenance of genomic stability. More than 90% of all mutations reported so far result in a premature truncation of the protein product with abnormal or abolished function. The histology of breast cancer in BRCA1 mutation carriers differs from that in sporadic cases, but mutation analysis is the only way to find the carrier. Like BRCA1, BRCA2 is involved in the development of breast cancer, and like BRCA1 plays a role in DNA repair. However, unlike BRCA1, it is not involved in ovarian cancer.

Other genes have been linked to breast cancer, for example c-erb-2 (HER2) and p53 (Beenken et al., *Ann. Surg.* 233(5):630–638 (2001). Overexpression of c-erb-2 (HER2) and p53 have been correlated with poor prognosis (Rudolph et al., *Hum. Pathol.* 32(3):311–319 (2001), as has been aberrant expression products of mdm2 (Lukas et al., *Cancer Res.* 61(7):3212–3219 (2001) and cyclin1 and p27 (Porter & Roberts, International Publication WO98/33450, published Aug. 6, 1998). However, no other clinically useful markers consistently associated with breast cancer have been identified.

Sporadic tumors, those not currently associated with a known germline mutation, constitute the majority of breast cancers. It is also likely that other, non-genetic factors also have a significant effect on the etiology of the disease. Regardless of the cancer's origin, breast cancer morbidity and mortality increases significantly if it is not detected early in its progression. Thus, considerable effort has focused on the early detection of cellular transformation and tumor formation in breast tissue.

A marker-based approach to tumor identification and characterization promises improved diagnostic and prognostic reliability. Typically, the diagnosis of breast cancer requires histopathological proof of the presence of the tumor. In addition to diagnosis, histopathological examinations also provide information about prognosis and selection of treatment regimens. Prognosis may also be established based upon clinical parameters such as tumor size, tumor grade, the age of the patient, and lymph node metastasis.

Diagnosis and/or prognosis may be determined to varying degrees of effectiveness by direct examination of the outside of the breast, or through mammography or other X-ray imaging methods (Jatoi, *Am. J. Surg.* 177:518–524 (1999)). The latter approach is not without considerable cost, however. Every time a mammogram is taken, the patient incurs a small risk of having a breast tumor induced by the ionizing properties of the radiation used during the test. In addition, the process is expensive and the subjective interpretations of a technician can lead to imprecision. For example, one study showed major clinical disagreements for about one-third of a set of mammograms that were interpreted individually by a surveyed group of radiologists. Moreover, many women find that undergoing a mammogram is a painful experience. Accordingly, the National Cancer Institute has not recommended mammograms for women under fifty years of age, since this group is not as likely to develop breast cancers as are older women. It is compelling to note, however, that while only about 22% of breast cancers occur in women under fifty, data suggests that breast cancer is more aggressive in pre-menopausal women.

In clinical practice, accurate diagnosis of various subtypes of breast cancer is important because treatment options, prognosis, and the likelihood of therapeutic response all vary broadly depending on the diagnosis. Accurate prognosis, or determination of distant metastasis-free survival could allow the oncologist to tailor the administration of adjuvant chemotherapy, with women having poorer prognoses being given the most aggressive treatment. Furthermore, accurate prediction of poor prognosis would greatly impact clinical trials for new breast cancer therapies, because potential study patients could then be stratified according to prognosis. Trials could then be limited to patients having poor prognosis, in turn making it easier to discern if an experimental therapy is efficacious.

To date, no set of satisfactory predictors for prognosis based on the clinical information alone has been identified. The detection of BRCA1 or BRCA2 mutations represents a step towards the design of therapies to better control and prevent the appearance of these tumors. However, there is no equivalent means for the diagnosis of patients with sporadic tumors, the most common type of breast cancer tumor, nor is there a means of differentiating subtypes of breast cancer.

Adjuvant systemic therapy has been shown to substantially improve the disease-free and overall survival in both premenopausal and postmenopausal women up to age 70 with lymph node negative and lymph node positive breast cancer. See Early Breast Cancer Trialists' Collaborative Group, *Lancet* 352(9132):930–942 (1998); Early Breast Cancer Trialists' Collaborative Group, *Lancet* 351(9114): 1451–1467 (1998). The absolute benefit from adjuvant treatment is larger for patients with poor prognostic features and this has resulted in the policy to select only these so-called 'high-risk' patients for adjuvant chemotherapy. Goldhirsch et al., Meeting highlights: International Consensus Panel on the Treatment of Primary Breast Cancer, Seventh International Conference on Adjuvant Therapy of Primary Breast Cancer, *J. Clin. Oncol.* 19(18):3817–3827 (2001); Eifel et al., National Institutes of Health Consensus Development Conference Statement: Adjuvant Therapy for Breast Cancer, Nov. 1–3, 2000, *J. Natl. Cancer Inst.* 93(13):979–989 (2001). Accepted prognostic and predictive factors in breast cancer include age, tumor size, axillary lymph node status, histological tumor type, pathological grade and hormone receptor status. A large number of other factors has been investigated for their potential to predict disease outcome, but these have in general only limited predictive power. Isaacs et al., *Semin. Oncol.* 28(1):53–67 (2001).

Using gene expression profiling with cDNA microarrays, Perou et al. showed that there are several subgroups of breast cancer patients based on unsupervised cluster analysis: those of "basal type" and those of "luminal type." Perou et al., *Nature* 406(6797):747–752 (2000). These subgroups differ with respect to outcome of disease in patients with locally advanced breast cancer. Sorlie et al., *Proc. Natl. Acad. Sci. U.S.A.* 98(19):10869–10874 (2001). In addition, microarray analysis has been used to identify diagnostic categories, e.g., BRCA1 and 2 (Hedenfalk et al., *N. Engl. J. Med.* 344(8): 539–548 (2001); van't Veer et al., *Nature* 415(6871):530–536 (2002)); estrogen receptor (Perou, supra; van't Veer, supra; Gruvberger et al., *Cancer. Res.* 61(16):5979–5984 (2001)) and lymph node status (West et al., *Proc. Natl. Acad. Sci. U.S.A.* 98(20):11462–11467 (2001); Ahr et al., *Lancet* 359(9301):131–132 (2002)).

3. SUMMARY OF THE INVENTION

The invention provides gene marker sets that distinguish various types and subtypes of breast cancer, and methods of use therefor. In one embodiment, the invention provides a method for classifying a cell sample as ER(+) or ER(−) comprising detecting a difference in the expression of a first plurality of genes relative to a control, said first plurality of genes consisting of at least 5 of the genes corresponding to the markers listed in Table 1. In specific embodiments, said plurality of genes consists of at least 50, 100, 200, 500, 1000, up to 2,460 of the gene markers listed in Table 1. In another specific embodiment, said plurality of genes consists of each of the genes corresponding to the 2,460 markers listed in Table 2. In another specific embodiment, said plurality consists of the 550 markers listed in Table 2. In another specific embodiment, said control comprises nucleic acids derived from a pool of tumors from individual sporadic patients. In another specific embodiment, said detecting comprises the steps of: (a) generating an ER(+) template by hybridization of nucleic acids derived from a plurality of ER(+) patients within a plurality of sporadic patients against nucleic acids derived from a pool of tumors from individual sporadic patients; (b) generating an ER(−) template by hybridization of nucleic acids derived from a plurality of ER(−) patients within said plurality of sporadic patients against nucleic acids derived from said pool of tumors from individual sporadic patients within said plurality; (c) hybridizing nucleic acids derived from an individual sample against said pool; and (d) determining the similarity of marker gene expression in the individual sample to the ER(+) template and the ER(−) template, wherein if said expression is more similar to the ER(+) template, the sample is classified as ER(+), and if said expression is more similar to the ER(−) template, the sample is classified as ER(−).

The invention further provides the above methods, applied to the classification of samples as BRCA1 or sporadic, and classifying patients as having good prognosis or poor prognosis. For the BRCA1/sporadic gene markers, the invention provides that the method may be used wherein the plurality of genes is at least 5, 20, 50, 100, 200 or 300 of the BRCA1/sporadic markers listed in Table 3. In a specific embodiment, the optimum 100 markers listed in Table 4 are used. For the prognostic markers, the invention provides that at least 5, 20, 50, 100, or 200 gene markers listed in Table 5 may be used. In a specific embodiment, the optimum 70 markers listed in Table 6 are used.

The invention further provides that markers may be combined. Thus, in one embodiment, at least 5 markers from Table 1 are used in conjunction with at least 5 markers from Table 3. In another embodiment, at least 5 markers from Table 5 are used in conjunction with at least 5 markers from Table 3. In another embodiment, at least 5 markers from Table 1 are used in conjunction with at least 5 markers from Table 5. In another embodiment, at least 5 markers from each of Tables 1, 3, and 5 are used simultaneously.

The invention further provides a method for classifying a sample as ER(+) or ER(−) by calculating the similarity between the expression of at least 5 of the markers listed in Table 1 in the sample to the expression of the same markers in an ER(−) nucleic acid pool and an ER(+) nucleic acid pool, comprising the steps of: (a) labeling nucleic acids derived from a sample, with a first fluorophore to obtain a first pool of fluorophore-labeled nucleic acids; (b) labeling with a second fluorophore a first pool of nucleic acids derived from two or more ER(+) samples, and a second pool of nucleic acids derived from two or more ER(−) samples;

(c) contacting said first fluorophore-labeled nucleic acid and said first pool of second fluorophore-labeled nucleic acid with said first microarray under conditions such that hybridization can occur, and contacting said first fluorophore-labeled nucleic acid and said second pool of second fluorophore-labeled nucleic acid with said second microarray under conditions such that hybridization can occur, detecting at each of a plurality of discrete loci on the first microarray a first flourescent emission signal from said first fluorophore-labeled nucleic acid and a second fluorescent emission signal from said first pool of second fluorophore-labeled genetic matter that is bound to said first microarray under said conditions, and detecting at each of the marker loci on said second microarray said first fluorescent emission signal from said first fluorophore-labeled nucleic acid and a third fluorescent emission signal from said second pool of second fluorophore-labeled nucleic acid; (d) determining the similarity of the sample to the ER(−) and ER(+) pools by comparing said first fluorescence emission signals and said second fluorescence emission signals, and said first emission signals and said third fluorescence emission signals; and (e) classifying the sample as ER(+) where the first fluorescence emission signals are more similar to said second fluorescence emission signals than to said third fluorescent emission signals, and classifying the sample as ER(−) where the first fluorescence emission signals are more similar to said third fluorescence emission signals than to said second fluorescent emission signals, wherein said similarity is defined by a statistical method. The invention further provides that the other disclosed marker sets may be used in the above method to distinguish BRCA1 from sporadic tumors, and patients with poor prognosis from patients with good prognosis.

In a specific embodiment, said similarity is calculated by determining a first sum of the differences of expression levels for each marker between said first fluorophore-labeled nucleic acid and said first pool of second fluorophore-labeled nucleic acid, and a second sum of the differences of expression levels for each marker between said first fluorophore-labeled nucleic acid and said second pool of second fluorophore-labeled nucleic acid, wherein if said first sum is greater than said second sum, the sample is classified as ER(−), and if said second sum is greater than said first sum, the sample is classified as ER(+). In another specific embodiment, said similarity is calculated by computing a first classifier parameter $P_1$ between an ER(+) template and the expression of said markers in said sample, and a second classifier parameter P2 between an ER(−) template and the expression of said markers in said sample, wherein said P1 and P2 are calculated according to the formula:

$$P_i = (\vec{z}_i \cdot \vec{y})/(\|\vec{z}_i\| \cdot \|\vec{y}\|),  \quad \text{Equation (1)}$$

wherein $\vec{z}_1$ and $\vec{z}_2$ are ER(−) and ER(+) templates, respectively, and are calculated by averaging said second fluorescence emission signal for each of said markers in said first pool of second fluorophore-labeled nucleic acid and said third fluorescence emission signal for each of said markers in said second pool of second fluorophore-labeled nucleic acid, respectively, and wherein $\vec{y}$ is said first fluorescence emission signal of each of said markers in the sample to be classified as ER(+) or ER(−), wherein the expression of the markers in the sample is similar to ER(+) if $P_1 < P_2$, and similar to ER(−) if $P_1 > P_2$.

The invention further provides a method for identifying marker genes the expression of which is associated with a particular phenotype. In one embodiment, the invention provides a method for determining a set of marker genes whose expression is associated with a particular phenotype, comprising the steps of: (a) selecting the phenotype having two or more phenotype categories; (b) identifying a plurality of genes wherein the expression of said genes is correlated or anticorrelated with one of the phenotype categories, and wherein the correlation coefficient for each gene is calculated according to the equation $$\rho = (\vec{c} \cdot \vec{r})/(\|\vec{c}\| \cdot \|\vec{r}\|) \quad \text{Equation (2)}$$

wherein $\vec{c}$ is a number representing said phenotype category and $\vec{r}$ is the logarithmic expression ratio across all the samples for each individual gene, wherein if the correlation coefficient has an absolute value of a threshold value or greater, said expression of said gene is associated with the phenotype category, and wherein said plurality of genes is a set of marker genes whose expression is associated with a particular phenotype. The threshold depends upon the number of samples used; the threshold can be calculated as $3 \times 1/\sqrt{n-3}$, where $1/\sqrt{n-3}$ is the distribution width and n=the number of samples. In a specific embodiment where n=98, said threshold value is 0.3. In a specific embodiment, said set of marker genes is validated by: (a) using a statistical method to randomize the association between said marker genes and said phenotype category, thereby creating a control correlation coefficient for each marker gene; (b) repeating step (a) one hundred or more times to develop a frequency distribution of said control correlation coefficients for each marker gene; (c) determining the number of marker genes having a control correlation coefficient of a threshold value or above, thereby creating a control marker gene set; and (d) comparing the number of control marker genes so identified to the number of marker genes, wherein if the p value of the difference between the number of marker genes and the number of control genes is less than 0.01, said set of marker genes is validated. In another specific embodiment, said set of marker genes is optimized by the method comprising: (a) rank-ordering the genes by amplitude of correlation or by significance of the correlation coefficients, and (b) selecting an arbitrary number of marker genes from the top of the rank-ordered list. The threshold value depends upon the number of samples tested.

The invention further provides a method for assigning a person to one of a plurality of categories in a clinical trial, comprising determining for each said person the level of expression of at least five of the prognosis markers listed in Table 6, determining therefrom whether the person has an expression pattern that correlates with a good prognosis or a poor prognosis, and assigning said person to one category in a clinical trial if said person is determined to have a good prognosis, and a different category if that person is determined to have a poor prognosis. The invention further provides a method for assigning a person to one of a plurality of categories in a clinical trial, where each of said categories is associated with a different phenotype, comprising determining for each said person the level of expression of at least five markers from a set of markers, wherein said set of markers includes markers associated with each of said clinical categories, determining therefrom whether the person has an expression pattern that correlates with one of the clinical categories, an assigning said person to one of said categories if said person is determined to have a phenotype associated with that category.

The invention further provides a method of classifying a first cell or organism as having one of at least two different phenotypes, said at least two different phenotypes comprising a first phenotype and a second phenotype, said method comprising: (a) comparing the level of expression of each of a plurality of genes in a first sample from the first cell or organism to the level of expression of each of said genes, respectively, in a pooled sample from a plurality of cells or organisms, said plurality of cells or organisms comprising different cells or organisms exhibiting said at least two different phenotypes, respectively, to produce a first compared value; (b) comparing said first compared value to a second compared value, wherein said second compared value is the product of a method comprising comparing the level of expression of each of said genes in a sample from a cell or organism characterized as having said first phenotype to the level of expression of each of said genes, respectively, in said pooled sample; (c) comparing said first compared value to a third compared value, wherein said third compared value is the product of a method comprising comparing the level of expression of each of said genes in a sample from a cell or organism characterized as having said second phenotype to the level of expression of each of said genes, respectively, in said pooled sample, (d) optionally carrying out one or more times a step of comparing said first compared value to one or more additional compared values, respectively, each additional compared value being the product of a method comprising comparing the level of expression of each of said genes in a sample from a cell or organism characterized as having a phenotype different from said first and second phenotypes but included among said at least two different phenotypes, to the level of expression of each of said genes, respectively, in said pooled sample; and (e) determining to which of said second, third and, if present, one or more additional compared values, said first compared value is most similar, wherein said first cell or organism is determined to have the phenotype of the cell or organism used to produce said compared value most similar to said first compared value.

In a specific embodiment of the above method, said compared values are each ratios of the levels of expression of each of said genes. In another specific embodiment, each of said levels of expression of each of said genes in said pooled sample are normalized prior to any of said comparing steps. In another specific embodiment, normalizing said levels of expression is carried out by dividing each of said levels of expression by the median or mean level of expression of each of said genes or dividing by the mean or median level of expression of one or more housekeeping genes in said pooled sample. In a more specific embodiment, said normalized levels of expression are subjected to a log transform and said comparing steps comprise subtracting said log transform from the log of said levels of expression of each of said genes in said sample from said cell or organism. In another specific embodiment, said at least two different phenotypes are different stages of a disease or disorder. In another specific embodiment, said at least two different phenotypes are different prognoses of a disease or disorder. In yet another specific embodiment, said levels of expression of each of said genes, respectively, in said pooled sample or said levels of expression of each of said genes in a sample from said cell or organism characterized as having said first phenotype, said second phenotype, or said phenotype different from said first and second phenotypes, respectively, are stored on a computer.

The invention further provides microarrays comprising the disclosed marker sets. In one embodiment, the invention provides a microarray comprising at least 5 markers derived from any one of Tables 1–6, wherein at least 50% of the probes on the microarray are present in any one of Tables 1–6. In more specific embodiments, at least 60%, 70%, 80%, 90%, 95% or 98% of the probes on said microarray are present in any one of Tables 1–6.

In another embodiment, the invention provides a microarray for distinguishing ER(+) and ER(−) cell samples comprising a positionally-addressable array of polynucleotide probes bound to a support, said polynucleotide probes comprising a plurality of polynucleotide probes of different nucleotide sequences, each of said different nucleotide sequences comprising a sequence complementary and hybridizable to a plurality of genes, said plurality consisting of at least 5 of the genes corresponding to the markers listed in Table 1 or Table 2, wherein at least 50% of the probes on the microarray are present in any one of Table 1 or Table 2. In yet another embodiment, the invention provides a microarray for distinguishing BRCA1-type and sporadic tumor-type cell samples comprising a positionally-addressable array of polynucleotide probes bound to a support, said polynucleotide probes comprising a plurality of polynucleotide probes of different nucleotide sequences, each of said different nucleotide sequences comprising a sequence complementary and hybridizable to a plurality of genes, said plurality consisting of at least 5 of the genes corresponding to the markers listed in Table 3 or Table 4, wherein at least 50% of the probes on the microarray are present in any one of Table 3 or Table 4. In still another embodiment, the invention provides a microarray for distinguishing cell samples from patients having a good prognosis and cell samples from patients having a poor prognosis comprising a positionally-addressable array of polynucleotide probes bound to a support, said polynucleotide probes comprising a plurality of polynucleotide probes of different nucleotide sequences, each of said different nucleotide sequences comprising a sequence complementary and hybridizable to a plurality of genes, said plurality consisting of at least 5 of the genes corresponding to the markers listed in Table 5 or Table 6, wherein at least 50% of the probes on the microarray are present in any one of Table 5 or Table 6. The invention further provides for microarrays comprising at least 5, 20, 50, 100, 200, 500, 100, 1,250, 1,500, 1,750, or 2,000 of the ER-status marker genes listed in Table 1, at least 5, 20, 50, 100, 200, or 300 of the BRCA1 sporadic marker genes listed in Table 3, or at least 5, 20, 50, 100 or 200 of the prognostic marker genes listed in Table 5, in any combination, wherein at least 50%, 60%, 70%, 80%, 90%, 95% or 98% of the probes on said microarrays are present in Table 1, Table 3 and/or Table 5.

The invention further provides a kit for determining the ER-status of a sample, comprising at least two microarrays each comprising at least 5 of the markers listed in Table 1, and a computer system for determining the similarity of the level of nucleic acid derived from the markers listed in Table 1 in a sample to that in an ER(−) pool and an ER(+) pool, the computer system comprising a processor, and a memory encoding one or more programs coupled to the processor, wherein the one or more programs cause the processor to perform a method comprising computing the aggregate differences in expression of each marker between the sample and ER(−) pool and the aggregate differences in expression of each marker between the sample and ER(+) pool, or a method comprising determining the correlation of expression of the markers in the sample to the expression in the ER(−) and ER(+) pools, said correlation calculated according to Equation (4). The invention provides for kits able to distinguish BRCA1 and sporadic tumors, and samples from patients with good prognosis from samples from patients with poor prognosis, by inclusion of the appropriate marker gene sets. The invention further provides a kit for determining whether a sample is derived from a patient having a good prognosis or a poor prognosis, comprising at least one microarray comprising probes to at least 5 of the genes corresponding to the markers listed in Table 5, and a computer readable medium having recorded thereon one or more programs for determining the similarity of the level of nucleic acid derived from the markers listed in Table 5 in a sample to that in a pool of samples derived from individuals having a good prognosis and a pool of samples derived from individuals having a good prognosis, wherein the one or more programs cause a computer to perform a method comprising computing the aggregate differences in expression of each marker between the sample and the good prognosis pool and the aggregate differences in expression of each marker between the sample and the poor prognosis pool, or a method comprising determining the correlation of expression of the markers in the sample to the expression in the good prognosis and poor prognosis pools, said correlation calculated according to Equation (3).

The invention further provides a method for classifying a breast cancer patient according to prognosis, comprising: (a) comparing the respective levels of expression of at least five genes for which markers are listed in Table 5 in a cell sample taken from said breast cancer patient to respective control levels of expression of said at least five genes; and (b) classifying said breast cancer patient according to prognosis of his or her breast cancer based on the similarity between said levels of expression in said cell sample and said control levels. In a specific embodiment of this method, step (b) comprises determining whether said similarity exceeds one or more predetermined threshold values of similarity. In another more specific embodiment of this method, said control levels are the mean levels of expression of each of said at least five genes in a pool of tumor samples obtained from a plurality of breast cancer patients who have no distant metastases within five years of initial diagnosis. In another specific embodiment of this method, said control levels comprise the expression levels of said genes in breast cancer patients who have had no distant metastases within five years of initial diagnosis. In another specific embodiment of this method, said control levels comprise, for each of said at least five genes, mean log intensity values stored on a computer. In another specific embodiment of this method, said control levels comprise, for each of said at least five genes, the mean log intensity values that are listed in Table 7. In another specific embodiment of this method, said comparing step (a) comprises comparing the respective levels of expression of at least ten of said genes for which markers are listed in Table 5 in said cell sample to said respective control levels of said at least ten of said genes, wherein said control levels of expression of said at least ten genes are the average expression levels of each of said at least ten genes in a pool of tumor samples obtained from breast cancer patients who have had no distant metastases within five years of initial diagnosis. In another specific embodiment of this method, said comparing step (a) comprises comparing the respective levels of expression of at least 25 of said genes for which markers are listed in Table 5 in said cell sample to said respective control levels of expression of said at least 25 genes, wherein said control levels of expression of said at least 25 genes are the average expression levels of each of said at least 25 genes in a pool of tumor samples obtained from breast cancer patients who have had no distant metastases within five years of initial diagnosis. In another specific embodiment of this method, said comparing step (a) comprises comparing the respective levels of expression of each of said genes for which markers are listed in Table 6 in said cell sample to said respective control levels of expression of each of said genes for which markers are listed in Table 6, wherein said control levels of expression of each of said genes for which markers are listed in Table 6 are the average expression levels of each of said genes in a pool of tumor samples obtained from breast cancer patients who have had no distant metastases within five years of initial diagnosis.

The invention further provides for a method for classifying a breast cancer patient according to prognosis, comprising: (a) determining the similarity between the level of expression of each of at least five genes for which markers are listed in Table 5 in a cell sample taken from said breast cancer patient, to control levels of expression for each respective said at least five genes to obtain a patient similarity value; (b) providing selected first and second threshold values of similarity of said level of expression of each of said at least five genes to said control levels of expression to obtain first and second similarity threshold values, respectively, wherein said second similarity threshold indicates greater similarity to said control than does said first similarity threshold; and (c) classifying said breast cancer patient as having a first prognosis if said patient similarity value exceeds said first and said second similarity threshold values, a second prognosis if said level of expression of said genes exceeds said first similarity threshold value but does not exceed said second similarity threshold value, and a third prognosis if said level of expression of said genes does not exceed said first similarity threshold value or said second similarity threshold value. A specific embodiment of this method comprises determining, prior to step (a), said level of expression of said at least five genes. In another specific embodiment of this method, said determining in step (a) is carried out by a method comprising determining the degree of similarity between the level of expression of each of said at least five genes in a sample taken from said breast cancer patient to the level of expression of each of said at least five genes in a plurality of breast cancer patients who have had no relapse of breast cancer within five years of initial diagnosis. In another specific embodiment of this method, said determining in step (a) is carried out by a method comprising determining the difference between the absolute expression level of each of said at least five genes and the average expression level of each of said at least five genes in a pool of tumor samples obtained from a plurality of breast cancer patients who have had no relapse of breast cancer within five years of initial diagnosis. In another specific embodiment of this method, said first threshold value and said second threshold value are coefficients of correlation to the mean expression level of each of said at least five genes in a pool of tumor samples obtained from a plurality of breast cancer patients who have had no relapse of breast cancer within five years of initial diagnosis. In a more specific embodiment of this method, said first threshold similarity value and said second threshold similarity values are selected by a method comprising: (a) rank ordering in descending order said tumor samples that compose said pool of tumor samples by the degree of similarity between the level of expression of each said at least five genes in each of said tumor samples to the mean level of expression of said at least five genes of the remaining tumor samples that compose said pool to obtain a rank-ordered list, said degree of similarity being expressed as a similarity value; (b) determining an acceptable number of false negatives in said classifying step, wherein a false negative is a breast cancer patient for whom the expression levels of said at least five genes in said cell sample predicts that said breast cancer patient will have no distant metastases within the first five years after initial diagnosis, but who has had a distant metastasis within the first five years after initial diagnosis; (c) determining a similarity value above which in said rank ordered list fewer than said acceptable number of tumor samples are false negatives; (d) selecting said similarity value determined in step (c) as said first threshold similarity value; and (e) selecting a second similarity value, greater than said first similarity value, as said second threshold similarity value. In an even more specific embodiment of this method, said second threshold similarity value is selected in step (e) by a method comprising determining which of said tumor samples, taken from said breast cancer patients having a distant metastasis within the first five years after initial diagnosis, in said rank ordered list has the greatest similarity value, and selecting said greatest similarity value as said second threshold similarity value. In another even more specific embodiment of this method, said first and second threshold similarity values are correlation coefficients, and said first threshold similarity value is 0.4 and said second threshold similarity value is greater than 0.4. In another even more specific embodiment of this method, said first and second threshold similarity values are correlation coefficients, and said second threshold similarity value is 0.636.

The invention further provides a method of classifying a breast cancer patient according to prognosis comprising the steps of: (a) contacting first nucleic acids derived from a tumor sample taken from said breast cancer patient, and second nucleic acids derived from two or more tumor samples from breast cancer patients who have had no distant metastases within five years of initial diagnosis, with an array under conditions such that hybridization can occur, said array comprising a positionally-addressable ordered array of polynucleotide probes bound to a solid support, said polynucleotide probes being complementary and hybridizable to at least five of the genes respectively for which markers are listed in Table 5, or the RNA encoded by said genes, and wherein at least 50% of the probes on said array are hybridizable to genes respectively for which markers are listed in Table 5, or to the RNA encoded by said genes; (b) detecting at each of a plurality of discrete loci on said array a first fluorescent emission signal from said first nucleic acids and a second fluorescent emission signal from said second nucleic acids that are bound to said array under said conditions; (c) calculating the similarity between said first fluorescent emission signals and said second fluorescent emission signals across said at least five genes respectively for which markers are listed in Table 5; and (d)classifying said breast cancer patient according to prognosis of his or her breast cancer based on the similarity between said first fluorescent emission signals and said second fluorescent emission signals across said at least five genes respectively for which markers are listed in Table 5.

The invention further provides for methods of assigning therapeutic regimen to breast cancer patients. In one embodiment, the invention provides a method of assigning a therapeutic regimen to a breast cancer patient, comprising: (a) classifying said patient as having a "poor prognosis," "intermediate prognosis," or "very good prognosis" on the basis of the levels of expression of at least five genes for which markers are listed in Table 5; and (b) assigning said patient a therapeutic regimen, said therapeutic regimen (i) comprising no adjuvant chemotherapy if the patient is lymph node negative and is classified as having a good prognosis or an intermediate prognosis, or (ii) comprising chemotherapy if said patient has any other combination of lymph node status and expression profile.

The invention also provides a method of assigning a therapeutic regimen to a breast cancer patient, comprising: (a) determining the lymph node status for said patient; (b) determining the level of expression of at least five genes for which markers are listed in Table 5 in a cell sample from said patient, thereby generating an expression profile; (c) classifying said patient as having a "poor prognosis," "intermediate prognosis," or "very good prognosis" on the basis of said expression profile; and (d) assigning said patient a therapeutic regimen, said therapeutic regimen comprising no adjuvant chemotherapy if the patient is lymph node negative and is classified as having a good prognosis or an intermediate prognosis, or comprising chemotherapy if said patient has any other combination of lymph node status and classification. In a specific embodiment of this method, said therapeutic regimen assigned to lymph node negative patients classified as having an "intermediate prognosis" additionally comprises adjuvant hormonal therapy. In another specific embodiment of this method, said classifying step (c) is carried out by a method comprising: (a) rank ordering in descending order a plurality of breast cancer tumor samples that compose a pool of breast cancer tumor samples by the degree of similarity between the level of expression of said at least five genes in each of said tumor samples and the level of expression of said at least five genes across all remaining tumor samples that compose said pool, said degree of similarity being expressed as a similarity value; (b) determining an acceptable number of false negatives in said classifying step, wherein a false negative is a breast cancer patient for whom the expression levels of said at least five genes in said cell sample predicts that said breast cancer patient will have no distant metastases within the first five years after initial diagnosis, but who has had a distant metastasis within the first five years after initial diagnosis; (c) determining a similarity value above which in said rank ordered list said acceptable number of tumor samples or fewer are false negatives; (d) selecting said similarity value determined in step (c) as a first threshold similarity value; (e) selecting a second similarity value, greater than said first similarity value, as a second threshold similarity value; and (f) determining the similarity between the level of expression of each of said at least five genes in a breast cancer tumor sample from the breast cancer patient and the level of expression of each of said respective at least five genes in said pool, to obtain a patient similarity value, wherein if said patient similarity value equals or exceeds said second threshold similarity value, said patient is classified as having a "very good prognosis"; if said patient similarity value equals or exceeds said first threshold similarity value, but is less than said second threshold similarity value, said patient is classified as having an "intermediate prognosis"; and if said patient similarity value is less than said first threshold similarity value, said patient is classified as having a "poor prognosis." Another specific embodiment of this method comprises determining the estrogen receptor (ER) status of said patient, wherein if said patient is ER positive and lymph node negative, said therapeutic regimen assigned to said patient additionally comprises adjuvant hormonal therapy. In another specific embodiment of this method, said patient is 52 years of age or younger. In another specific embodiment of this method, said patient has stage I or stage II breast cancer. In yet another specific embodiment of this method, said patient is premenopausal.

The above methods may be computer-implemented. Thus, in another embodiment, the invention provides a computer program product for classifying a breast cancer patient according to prognosis, the computer program product for use in conjunction with a computer having a memory and a processor, the computer program product comprising a computer readable storage medium having a computer program encoded thereon, wherein said computer program product can be loaded into the one or more memory units of a computer and causes the one or more processor units of the computer to execute the steps of: (a) receiving a first data structure comprising the respective levels of expression of each of at least five genes for which markers are listed in Table 5 in a cell sample taken from said patient; (b) determining the similarity of the level of expression of each of said at least five genes to respective control levels of expression of said at least five genes to obtain a patient similarity value; (c) comparing said patient similarity value to selected first and second threshold values of similarity of said respective levels of expression of each of said at least five genes to said respective control levels of expression of said at least five genes, wherein said second threshold value of similarity indicates greater similarity to said respective control levels of expression of said at least five genes than does said first threshold value of similarity; and (d) classifying said patient as having a first prognosis if said patient similarity value exceeds said first and said second threshold similarity values; a second prognosis if said patient similarity value exceeds said first threshold similarity value but does not exceed said second threshold similarity value; and a third prognosis if said patient similarity value does not exceed said first threshold similarity value or said second threshold similarity value. In a specific embodiment of the computer program product, said first threshold value of similarity and said second threshold value of similarity are values stored in said computer. In another specific embodiment of the computer program product, said respective control levels of expression of said at least five genes is stored in said computer. In another specific embodiment of the computer program product, said first prognosis is a "very good prognosis"; said second prognosis is an "intermediate prognosis"; and said third prognosis is a "poor prognosis"; wherein said computer program may be loaded into the memory and further cause said one or more processor units of said computer to execute the step of assigning said breast cancer patient a therapeutic regimen comprising no adjuvant chemotherapy if the patient is lymph node negative and is classified as having a good prognosis or an intermediate prognosis, or comprising chemotherapy if said patient has any other combination of lymph node status and expression profile. In a more specific embodiment, said clinical data includes the lymph node and estrogen receptor (ER) status of said breast cancer patient. In yet another specific embodiment, said computer program may be loaded into the memory and further causes said one or more processor units of the computer to execute the steps of receiving a data structure comprising clinical data specific to said breast cancer patient. In another specific embodiment, said respective control levels of expression of said at least five genes comprises a set of single-channel mean hybridization intensity values for each of said at least five genes, stored on said computer readable storage medium. In a more specific embodiment of this computer program product, said single-channel mean hybridization intensity values are log transformed. In another specific embodiment of the computer program product, said computer program product causes said processing unit to perform said comparing step (c) by calculating the difference between the level of expression of each of said at least five genes in said cell sample taken from said breast cancer patient and said respective control levels of expression of said at least five genes. In another specific embodiment of the computer program product, said computer program product causes said processing unit to perform said comparing step (c) by calculating the mean log level of expression of each of said at least five genes in said control to obtain a control mean log expression level for each gene, calculating the log expression level for each of said at least five genes in a breast cancer sample from said patient to obtain a patient log expression level, and calculating the difference between the patient log expression level and the control mean log expression for each of said at least five genes. In another specific embodiment of the computer program product, said computer program product causes said processing unit to perform said comparing step (c) by calculating similarity between the level of expression of each of said at least five genes in said cell sample taken from said patient and said respective control levels of expression of said at least five genes, wherein said similarity is expressed as a similarity value. In a more specific embodiment of this computer program product, said similarity value is a correlation coefficient.

4. BRIEF DESCRIPTION OF THE FIGURES

FIG. 1 is a Venn-type diagram showing the overlap between the marker sets disclosed herein, including the 2,460 ER markers, the 430 BRCA1/sporadic markers, and the 231 prognosis reporters.

Figure 2:
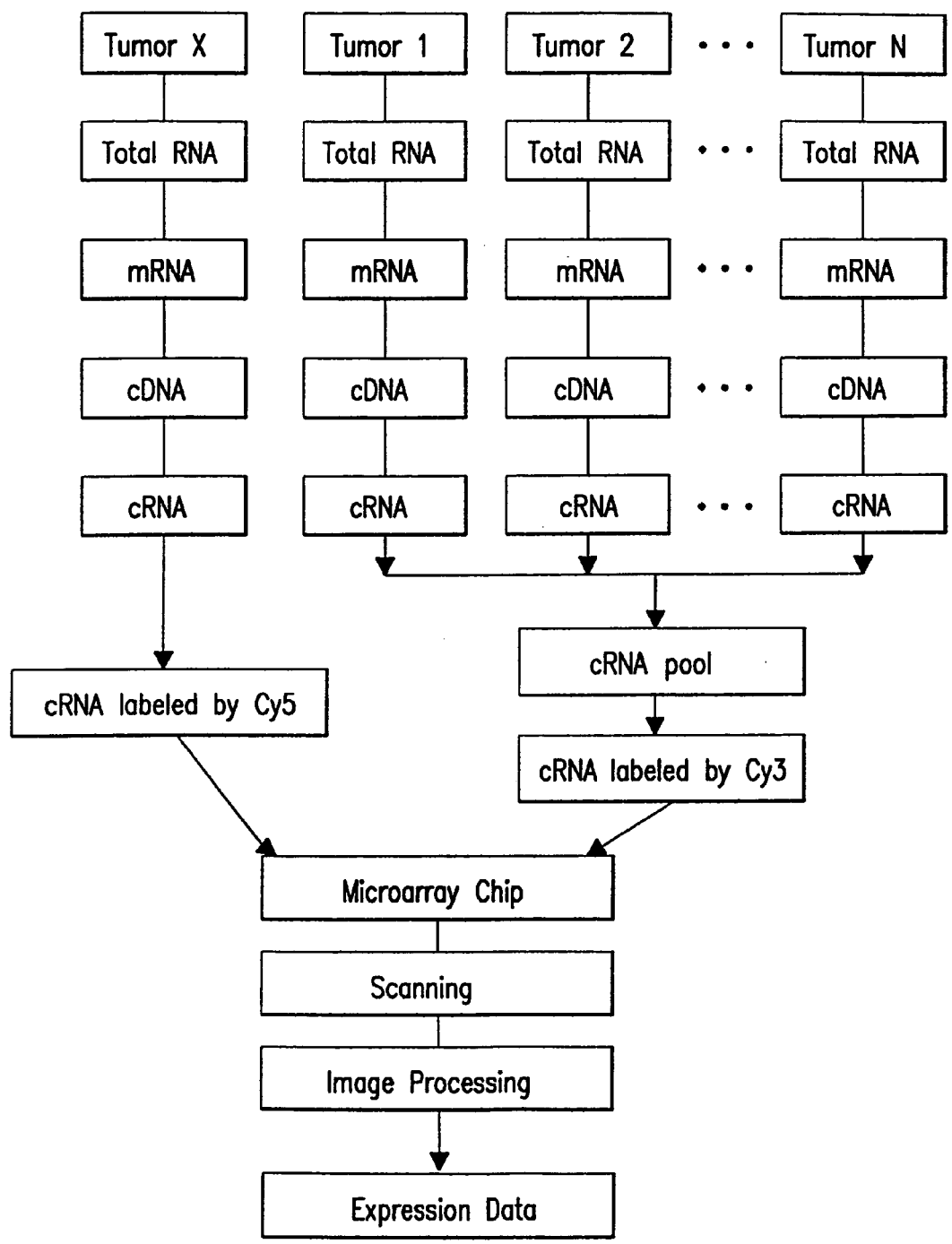

FIG. 2 shows the experimental procedures for measuring differential changes in mRNA transcript abundance in breast cancer tumors used in this study. In each experiment, Cy5-labeled cRNA from one tumor X is hybridized on a 25 k human microarray together with a Cy3-labeled cRNA pool made of cRNA samples from tumors 1, 2, . . . N. The digital expression data were obtained by scanning and image processing. The error modeling allowed us to assign a p-value to each transcript ratio measurement.

Figure 3:
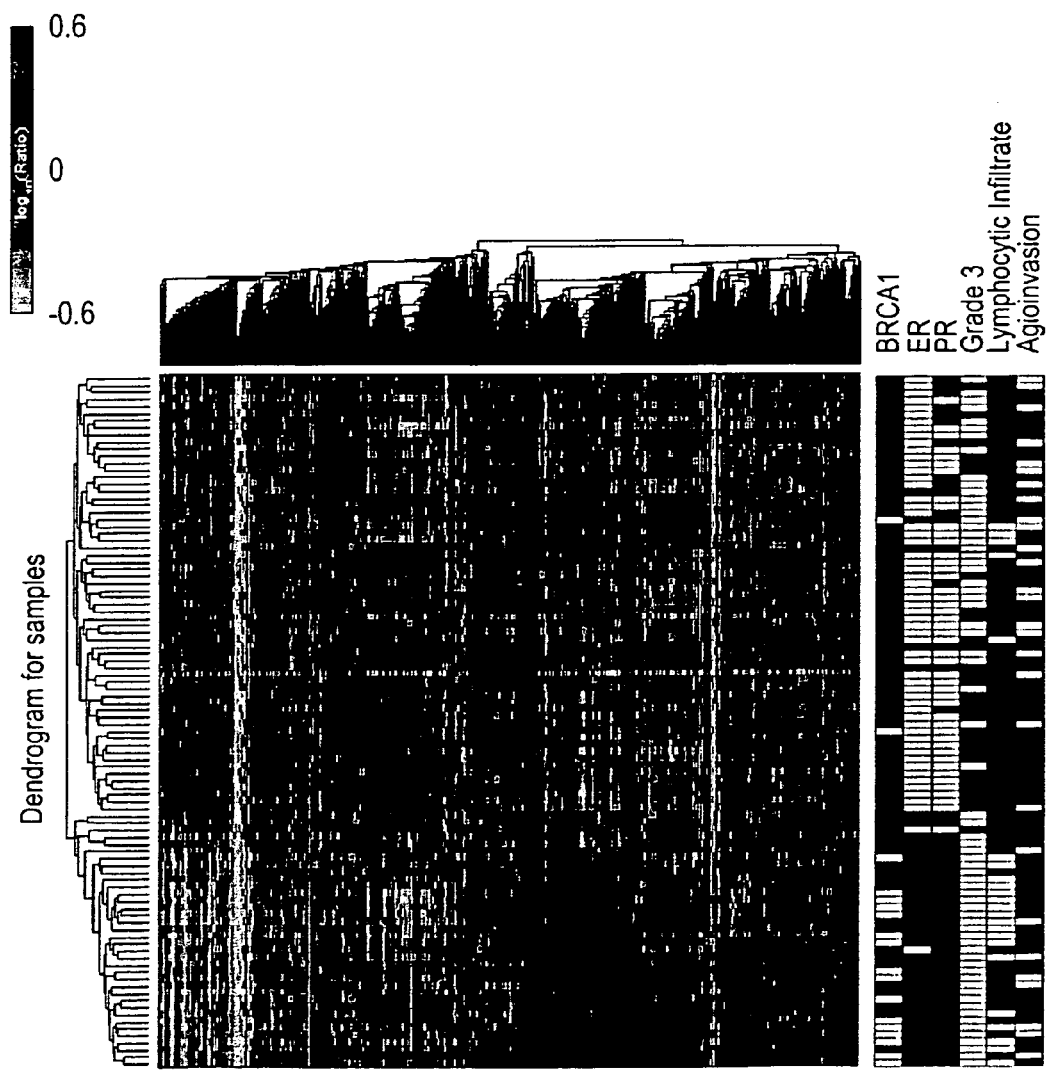

FIG. 3 Two-dimensional clustering reveals two distinctive types of tumors. The clustering was based on the gene expression data of 98 breast cancer tumors over 4986 significant genes. Dark gray (red) presents up-regulation, light gray (green) represents down-regulation, black indicates no change in expression, and gray indicates that data is not available. 4986 genes were selected that showed a more than two fold change in expression ratios in more than five experiments. Selected clinical data for test results of BR CA1 mutations, estrogen receptor (ER), and proestrogen receptor (PR), tumor grade, lymphocytic infiltrate, and angioinvasion are shown at right. Black denotes negative and white denotes positive. The dominant pattern in the lower part consists of 36 patients, out of which 34 are ER-negative (total 39), and 16 are BR CA1-mutation carriers (total 18).

Figure 4:
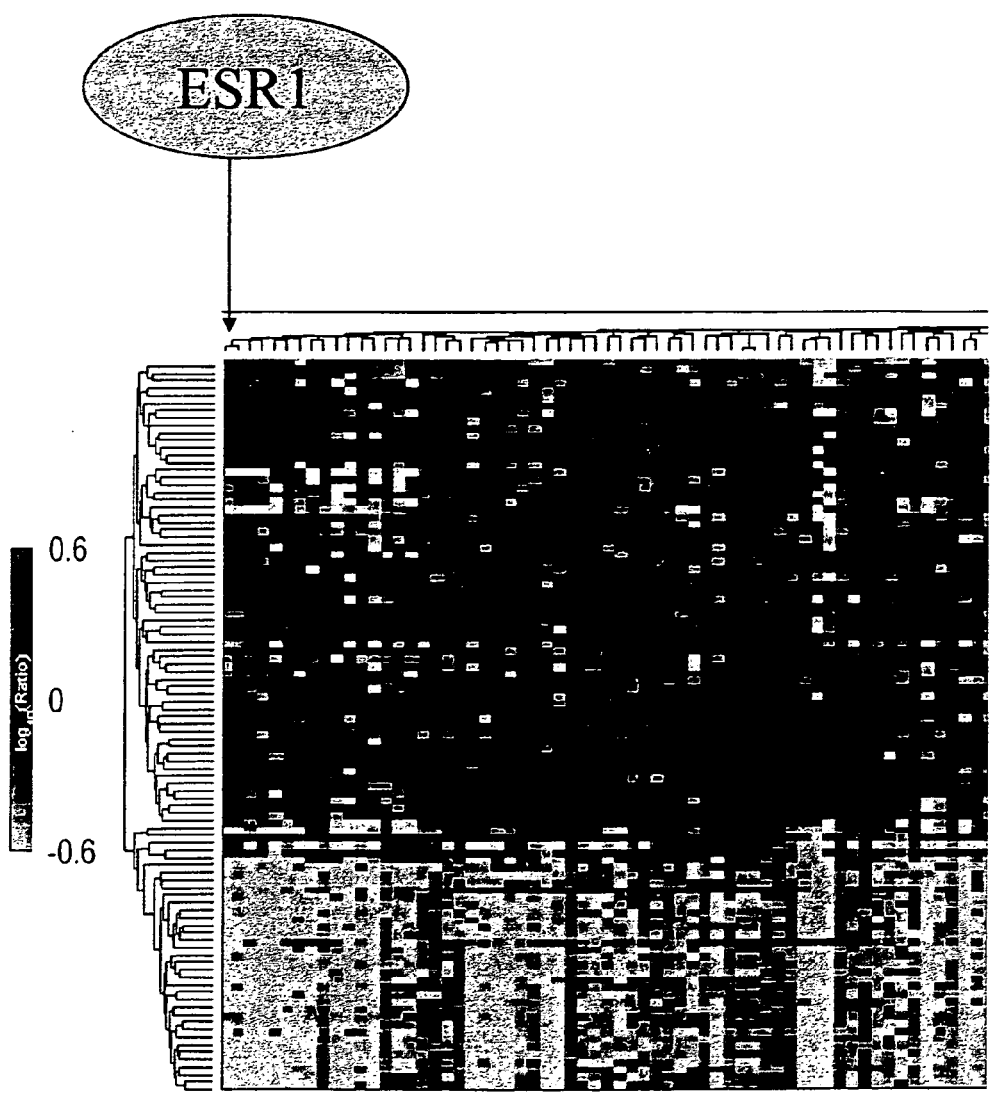

FIG. 4 A portion of unsupervised clustered results as shown in FIG. 3. ESR1 (the estrogen receptor gene) is coregulated with a set of genes that are strongly co-regulated to form a dominant pattern.

Figure 5A:
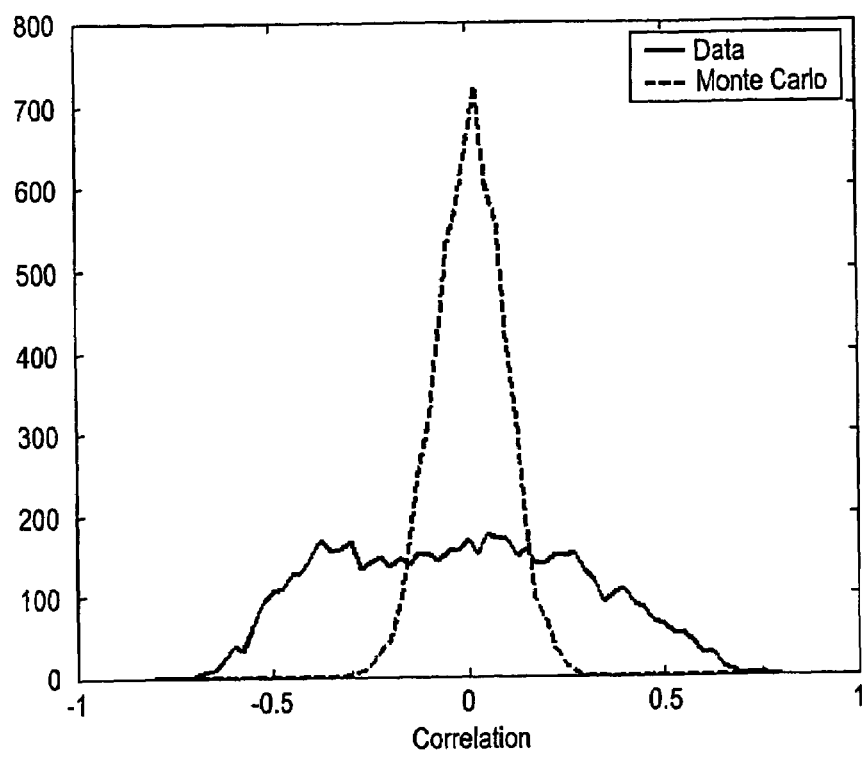

FIG. 5A Histogram of correlation coefficients of significant genes between their expression ratios and estrogen-receptor (ER) status (i.e., ER level). The histogram for experimental data is shown as a gray line. The results of one Monte-Carlo trial is shown in solid black. There are 2,460 genes whose expression data correlate with ER status at a level higher than 0.3 or anti-correlated with ER status at a level lower than −0.3.

Figure 5B:
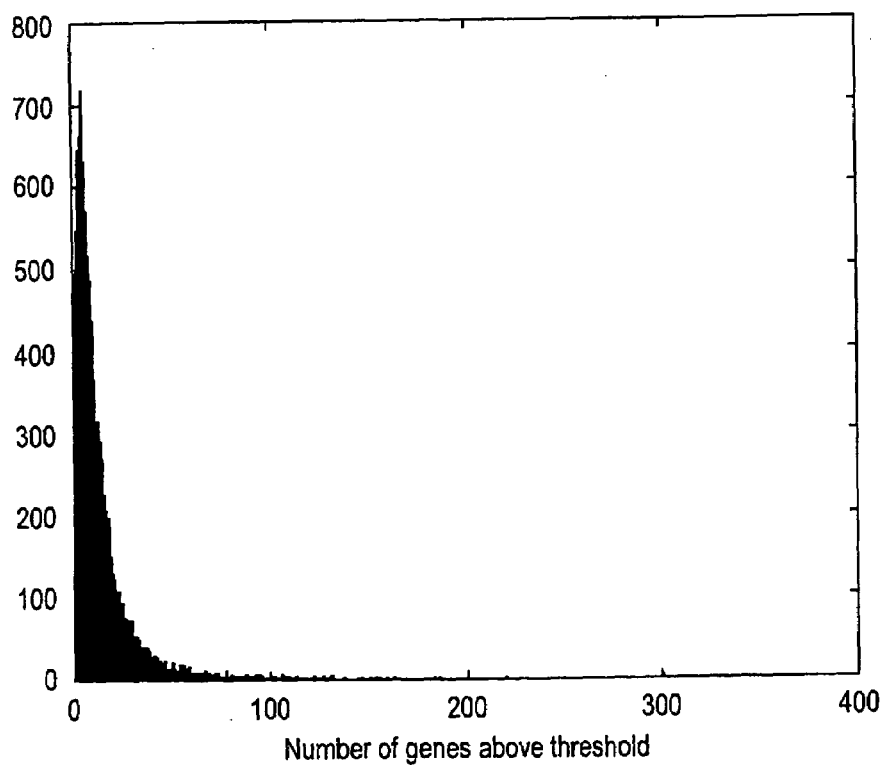

FIG. 5B The distribution of the number of genes that satisfied the same selection criteria (amplitude of correlation above 0.3) from 10,000 Monte-Carlo runs. It is estimated that this set of 2,460 genes reports ER status at a confidence level of p>99.99%.

Figure 6:
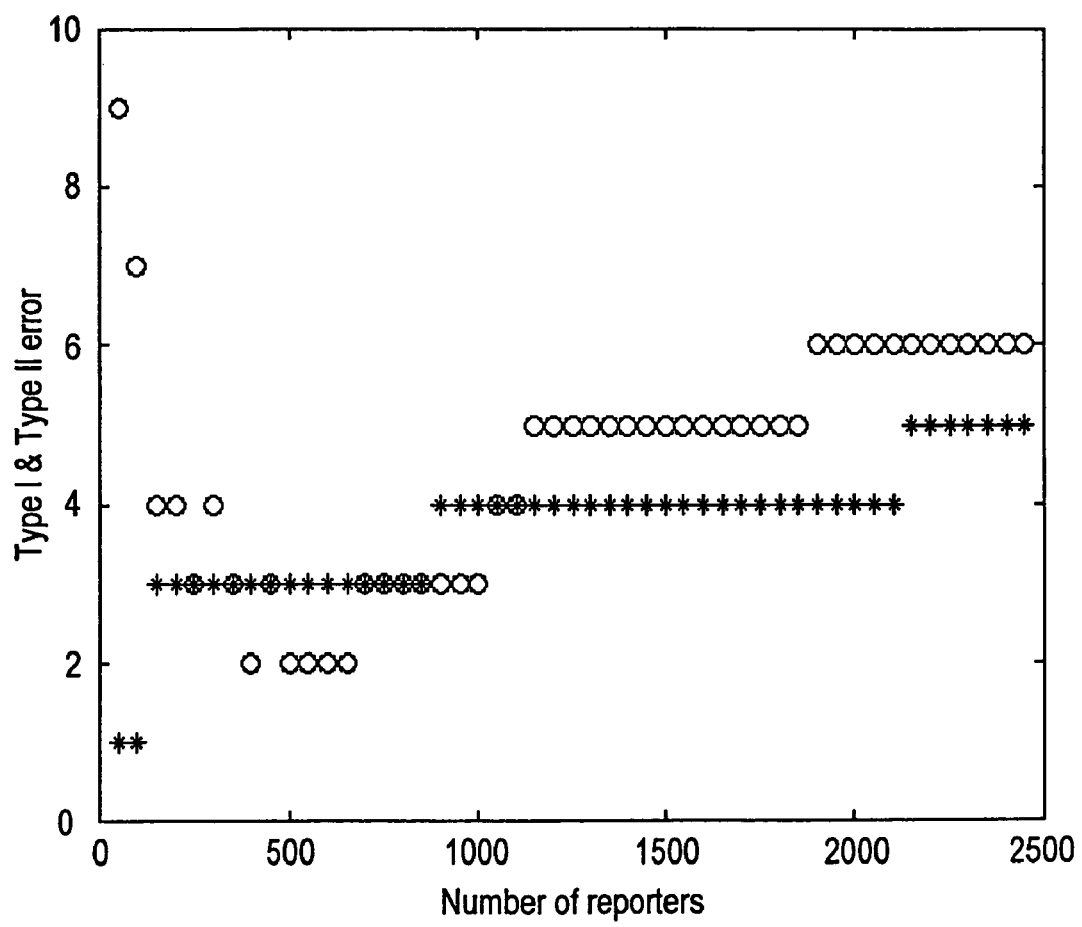

FIG. 6 Classification Type 1 and Type 2 error rates as a function of the number (out of 2,460) marker genes used in the classifier. The combined error rate is lowest when approximately 550 marker genes are used.

Figure 7:
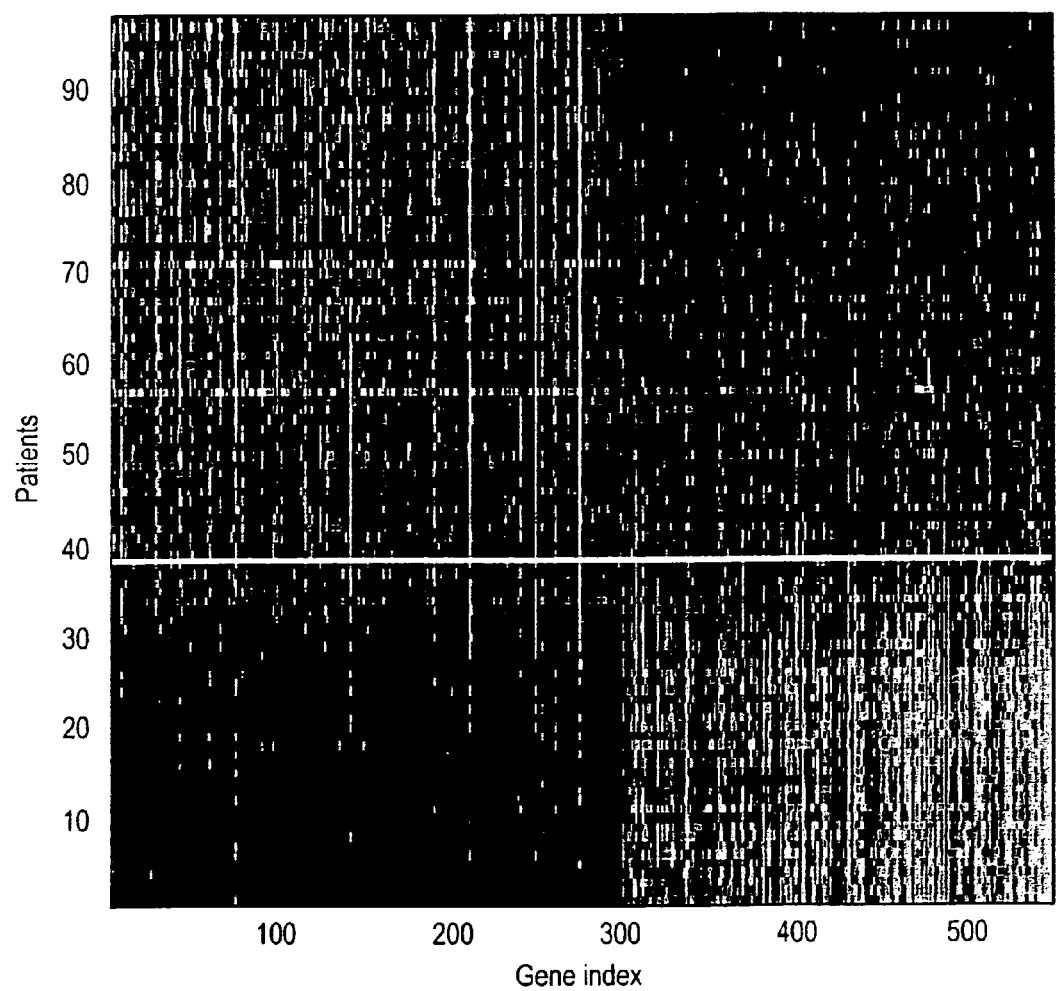

FIG. 7 Classification of 98 tumor samples as ER(+) or ER(−) based on expression levels of the 550 optimal marker genes. ER(+) samples (above white line) exhibit a clearly different expression pattern that ER(−) samples (below white line).

Figure 8:
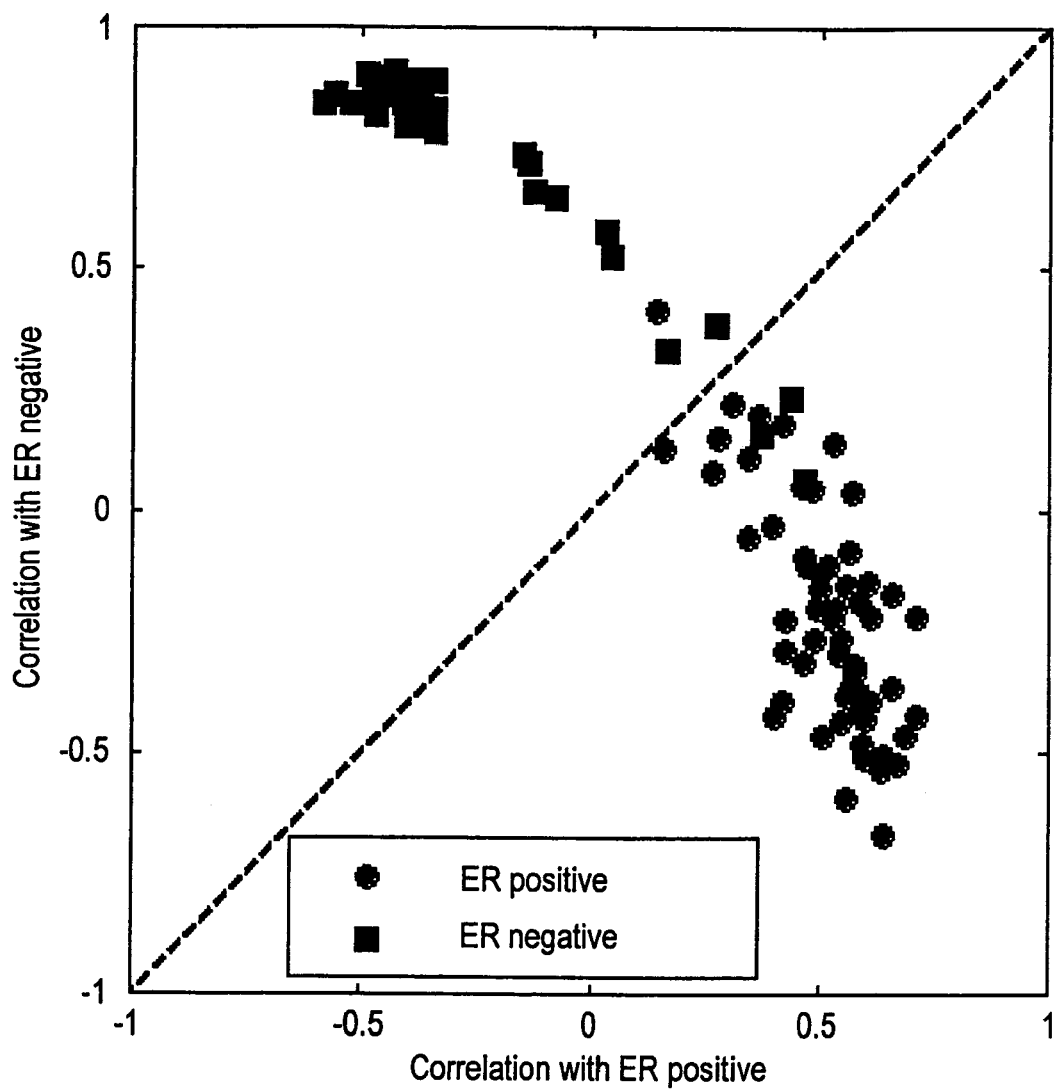

FIG. 8 Correlation between expression levels in samples from each patient and the average profile of the ER(−) group vs. correlation with the ER(+) group. Squares represent samples from clinically ER(−) patients; dots represent samples from clinically ER(+) patients.

Figure 9A:
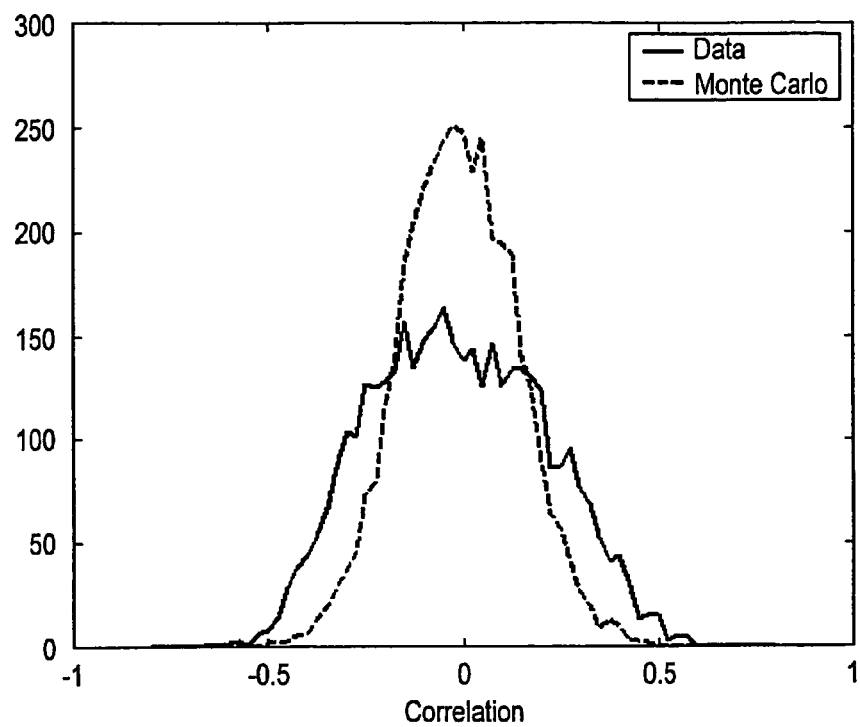

FIG. 9A Histogram of correlation coefficients of gene expression ratio of each significant gene with the BRCA1 mutation status is shown as a solid line. The dashed line indicates a frequency distribution obtained from one Monte-Carlo run. 430 genes exhibited an amplitude of correlation or anti-correlation greater than 0.35.

Figure 9B:
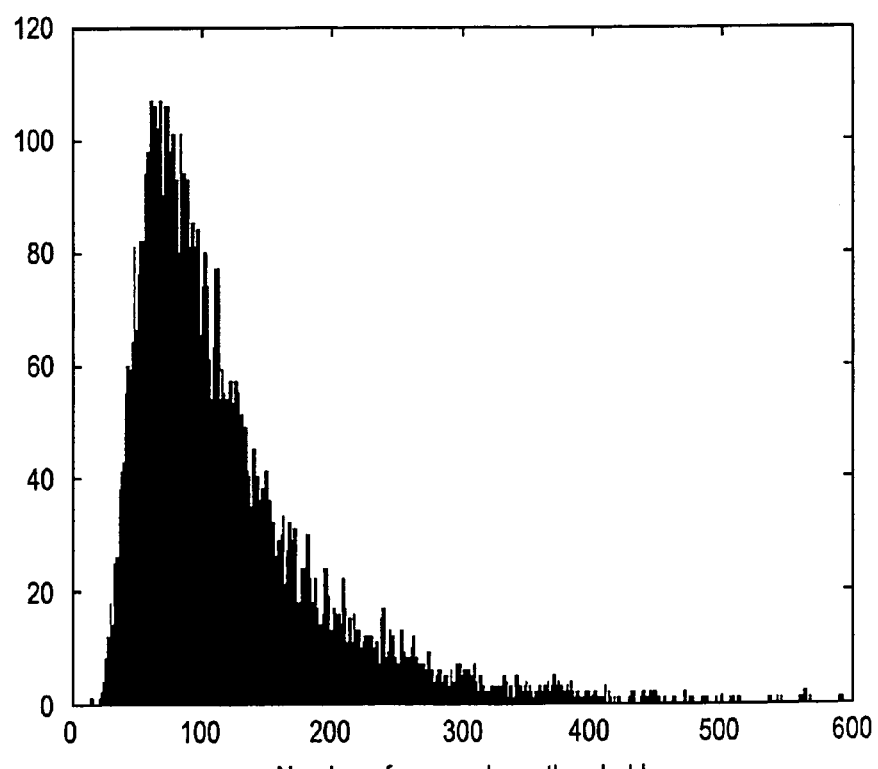

FIG. 9B Frequency distribution of the number of genes that exhibit an amplitude of correlation or anti-correlation greater than 0.35 for the 10,000 Monte-Carlo run control. Mean=115 p(n>430)=0.48% and p(>430/2)=9.0%.

Figure 10:
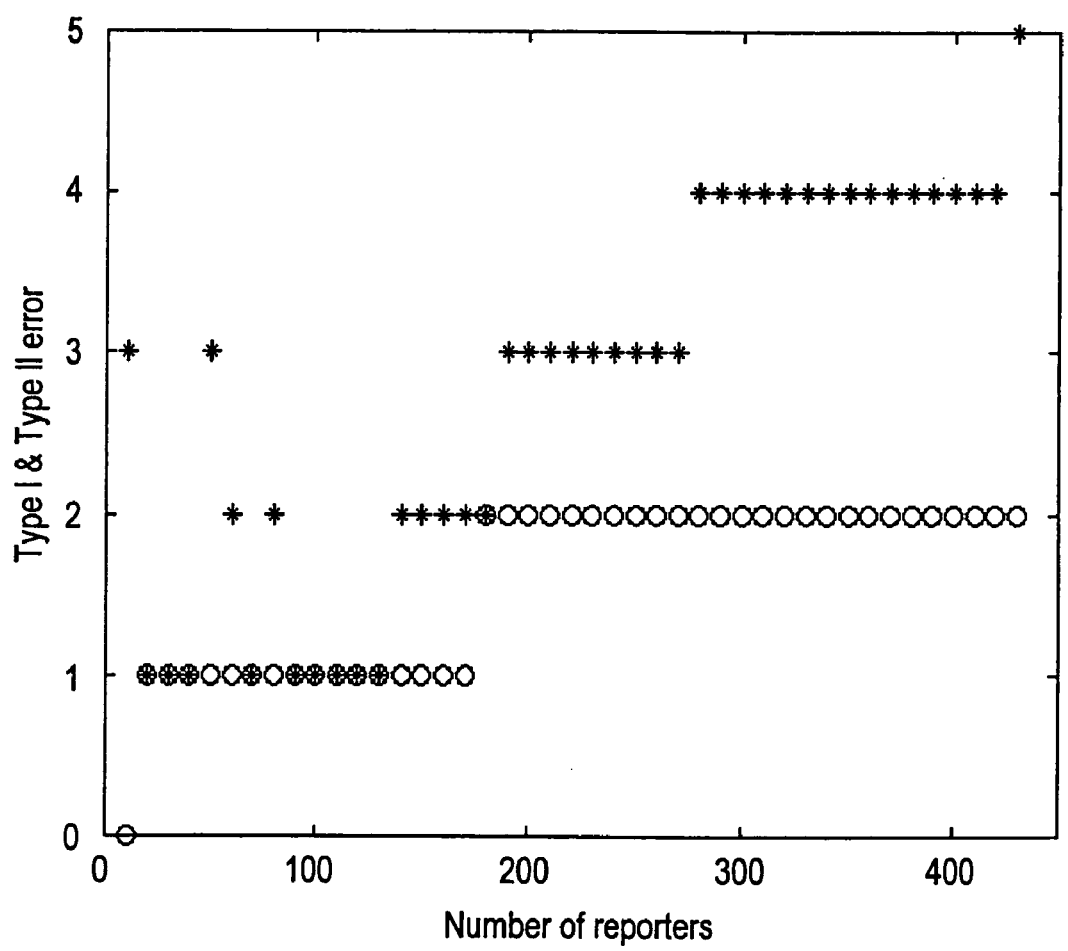

FIG. 10 Classification type 1 and type 2 error rates as a function of the number of discriminating genes used in the classifier (template). The combined error rate is lowest when approximately 100 discriminating marker genes are used.

Figure 11A:
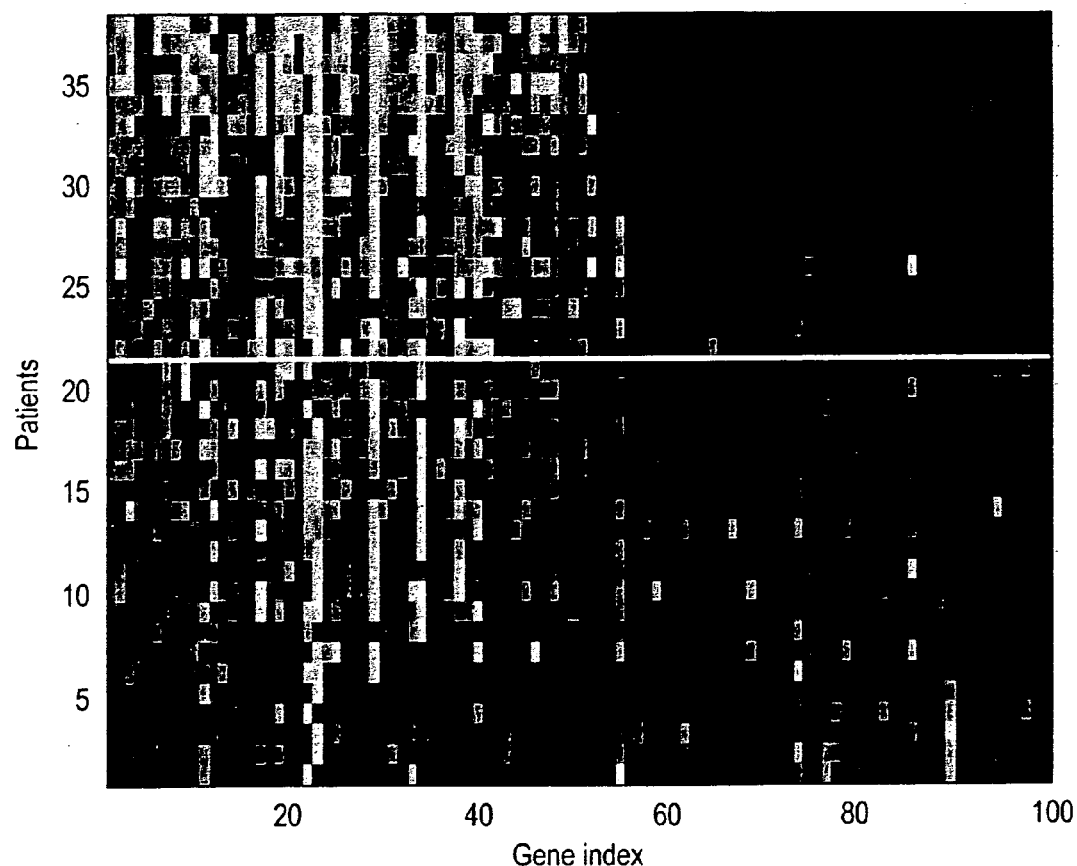

FIG. 11A The classification of 38 tumors in the ER(−) group into two subgroups, BR CA1 and sporadic, by using the optimal set of 100 discriminating marker genes. Patients above the white line are characterized by BRCA1-related patterns.

Figure 11B:
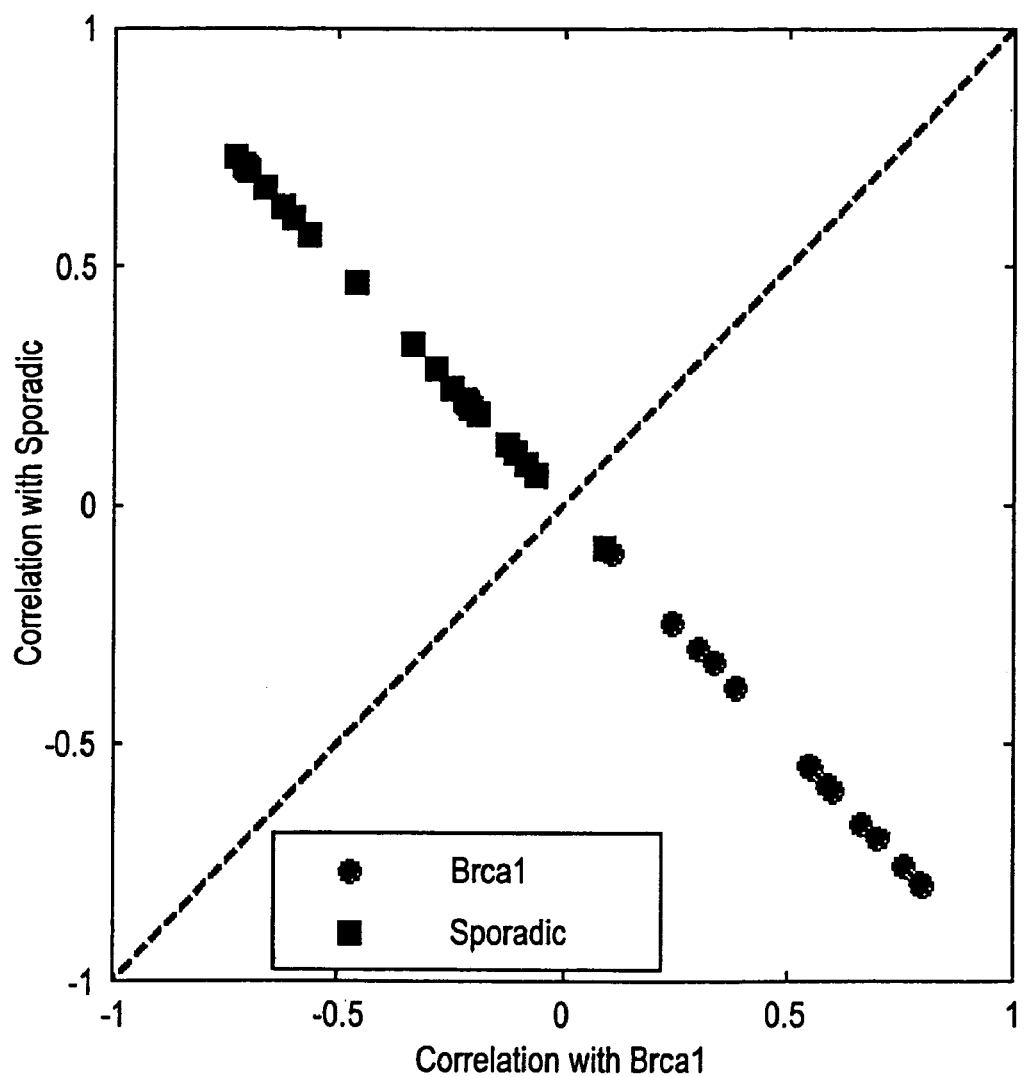

FIG. 11B Correlation between expression levels in samples from each ER(−) patient and the average profile of the BRCA1 group vs. correlation with the sporadic group. Squares represent samples from patients with sporadic-type tumors; dots represent samples from patients carrying the BRCA1 mutation.

Figure 12A:
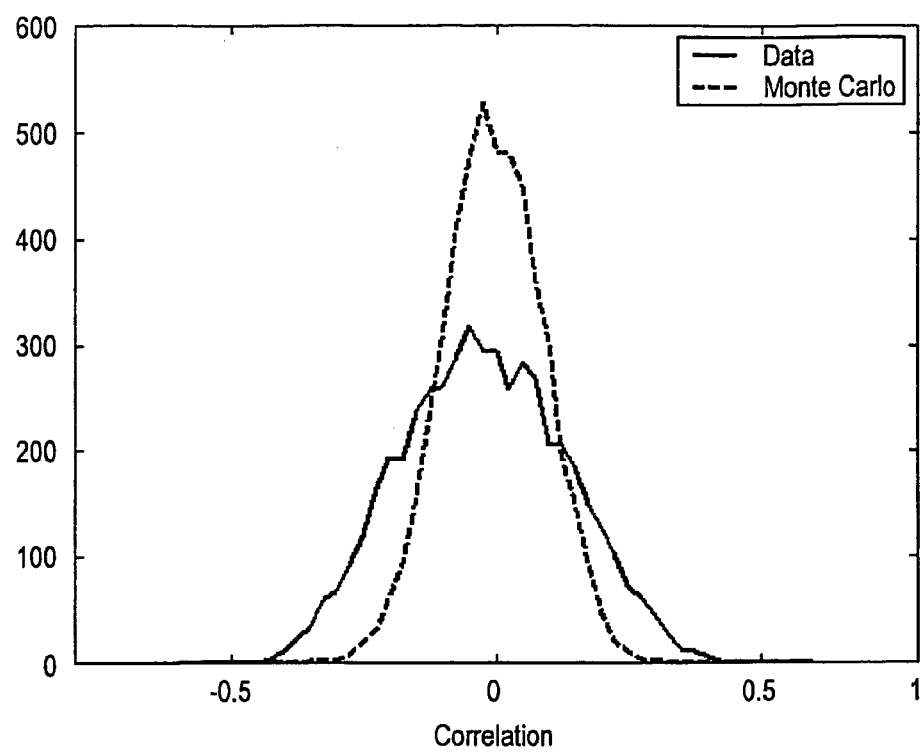

FIG. 12A Histogram of correlation coefficients of gene expression ratio of each significant gene with the prognostic category (distant metastases group and no distant metastases group) is shown as a solid line. The distribution obtained from one Monte-Carlo run is shown as a dashed line. The amplitude of correlation or anti-correlation of 231 marker genes is greater than 0.3.

Figure 12B:
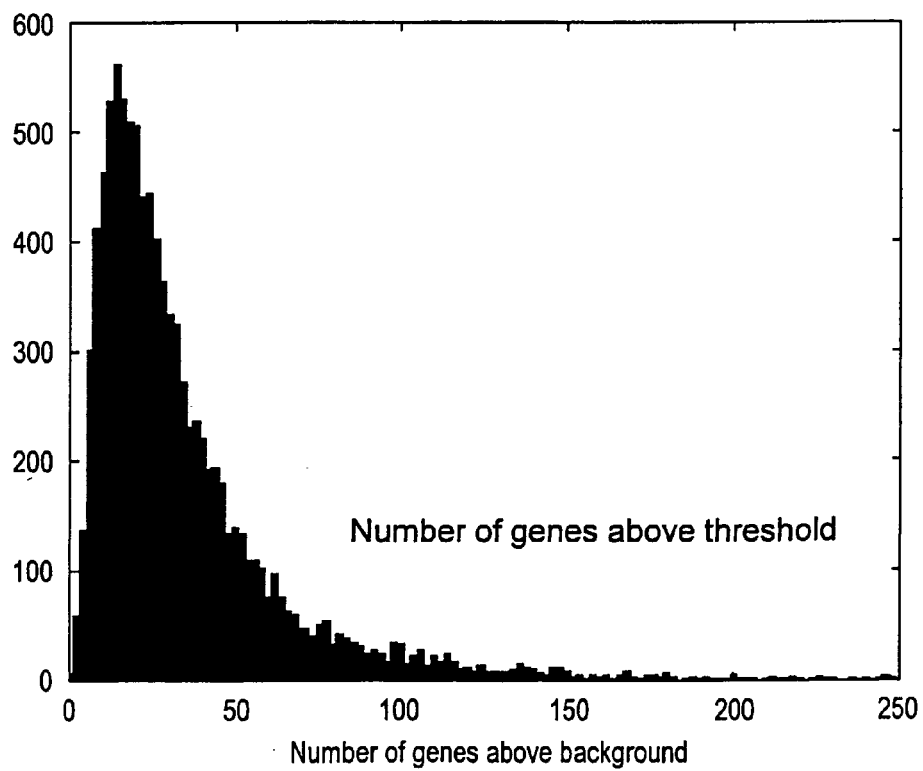

FIG. 12B Frequency distribution of the number of genes whose amplitude of correlation or anti-correlation was greater than 0.3 for 10,000 Monte-Carlo runs.

Figure 13:
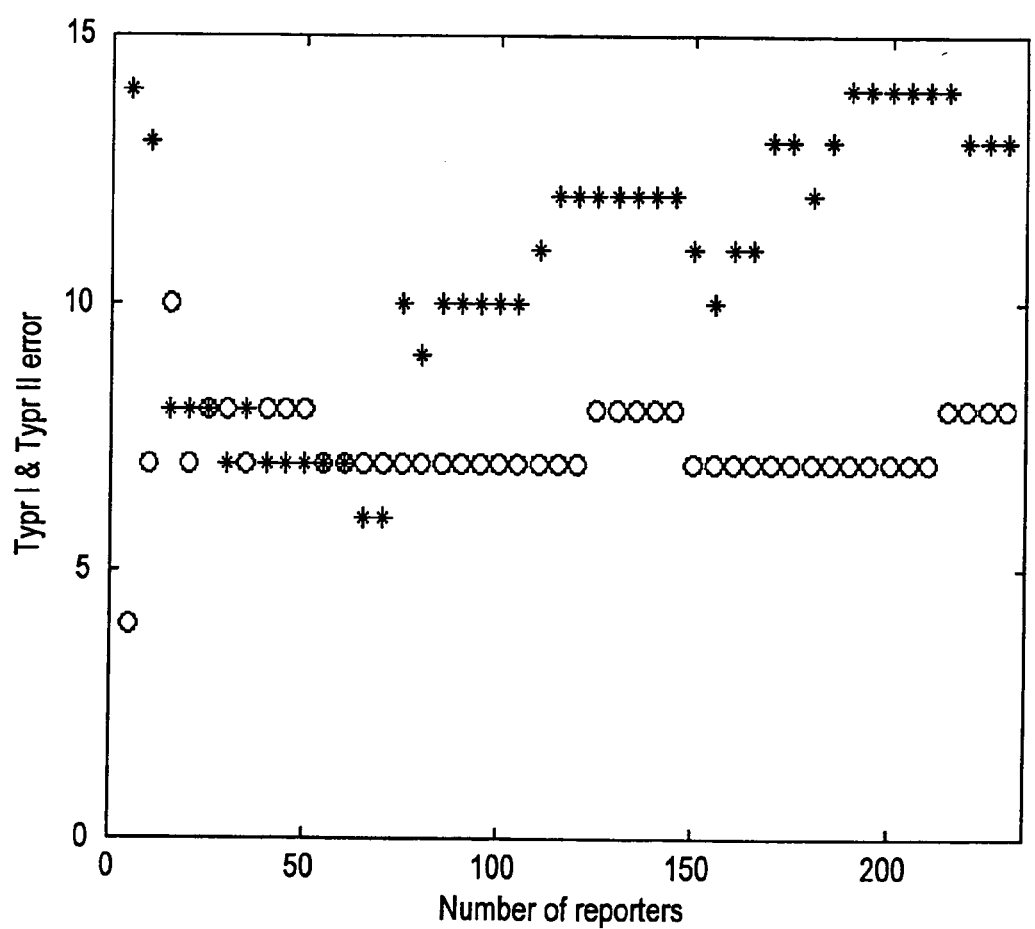

FIG. 13 The distant metastases group classification error rate for type 1 and type 2 as a function of the number of discriminating genes used in the classifier. The combined error rate is lowest when approximately 70 discriminating marker genes are used.

Figure 14:
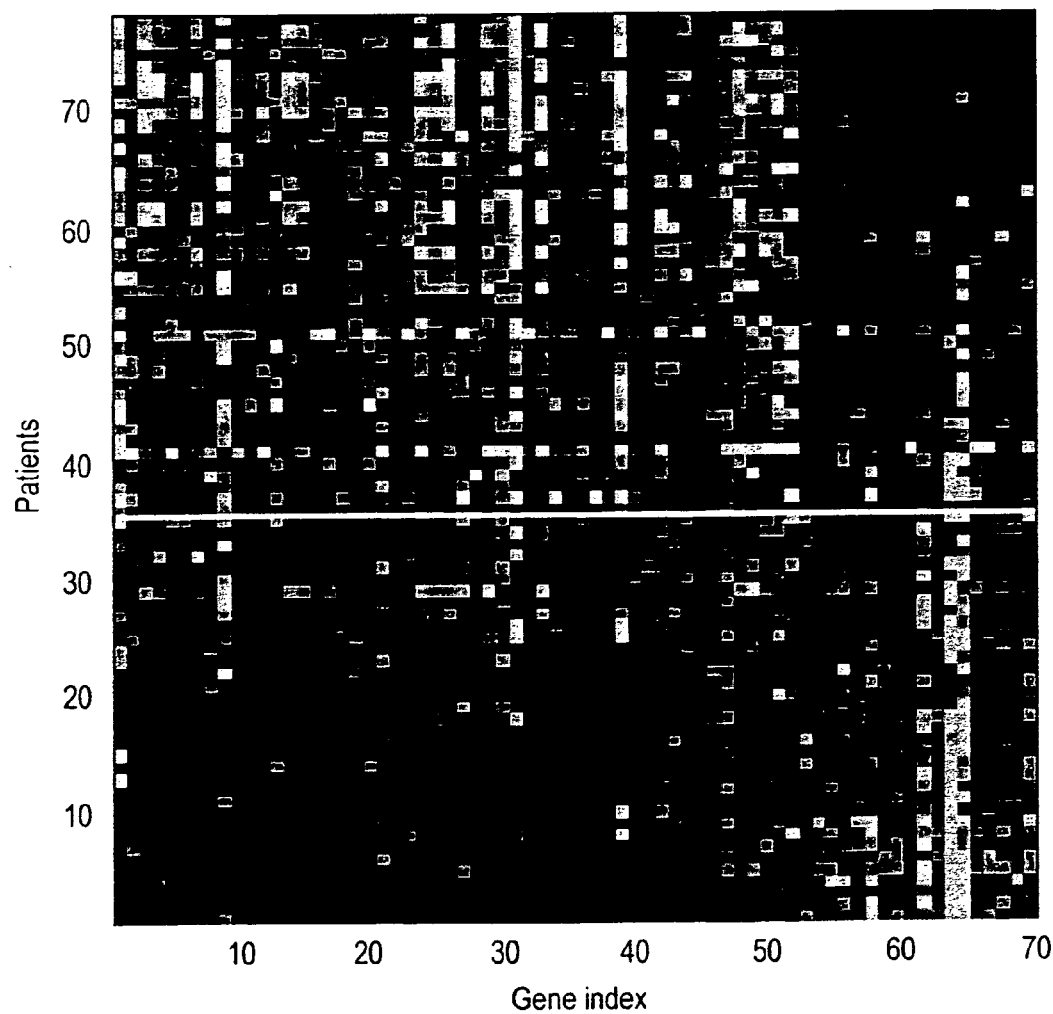

FIG. 14 Classification of 78 sporadic tumors into two prognostic groups, distant metastases (poor prognosis) and no distant metastases (good prognosis) using the optimal set of 70 discriminating marker genes. Patients above the white line are characterized by good prognosis. Patients below the white line are characterized by poor prognosis.

Figure 15:
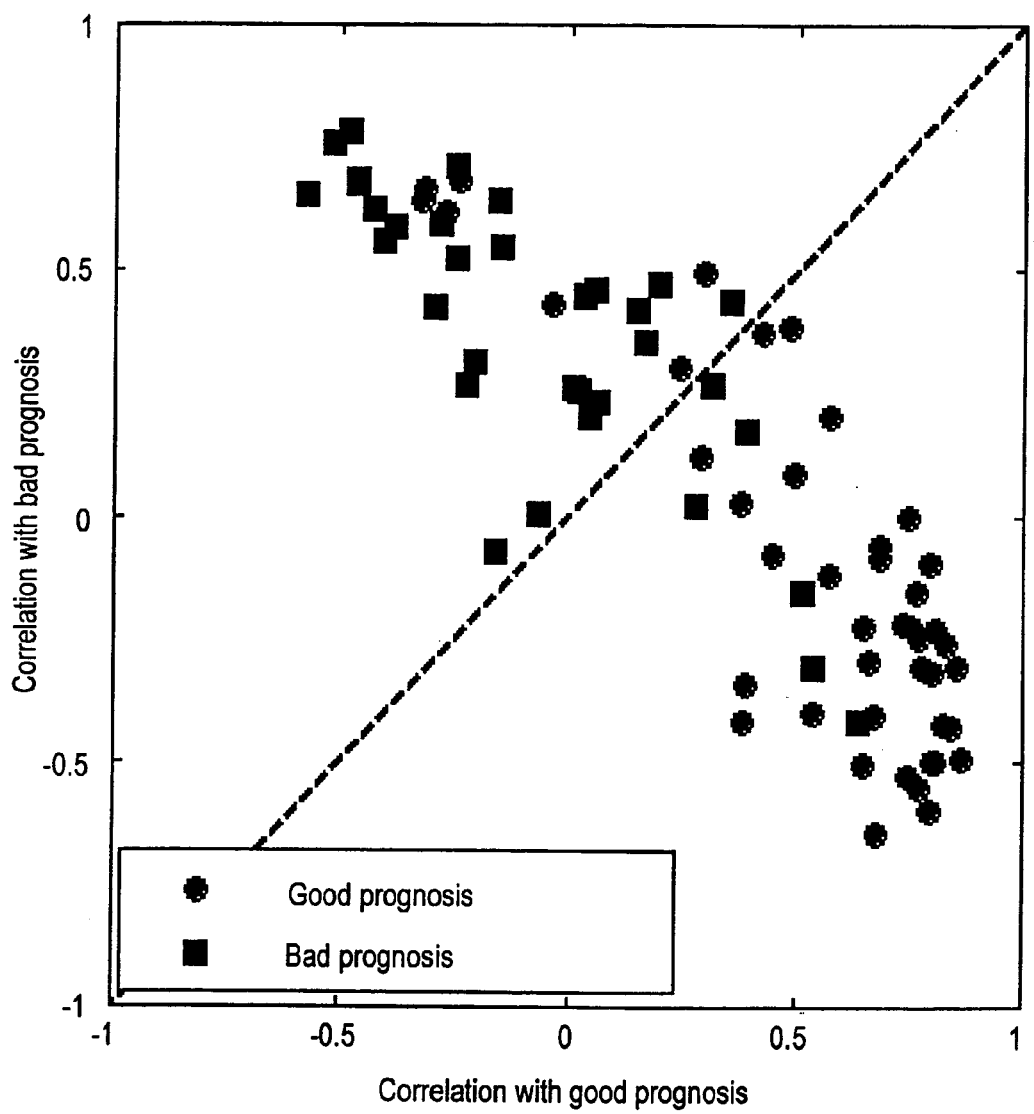

FIG. 15 Correlation between expression levels in samples from each patient and the average profile of the good prognosis group vs. correlation with the poor prognosis group. Squares represent samples from patients having a poor prognosis; dots represent samples from patients having a good prognosis. Red squares represent the 'reoccurred' patients and the blue dots represent the 'non-reoccurred'. A total of 13 out of 78 were mis-classified.

Figure 16:
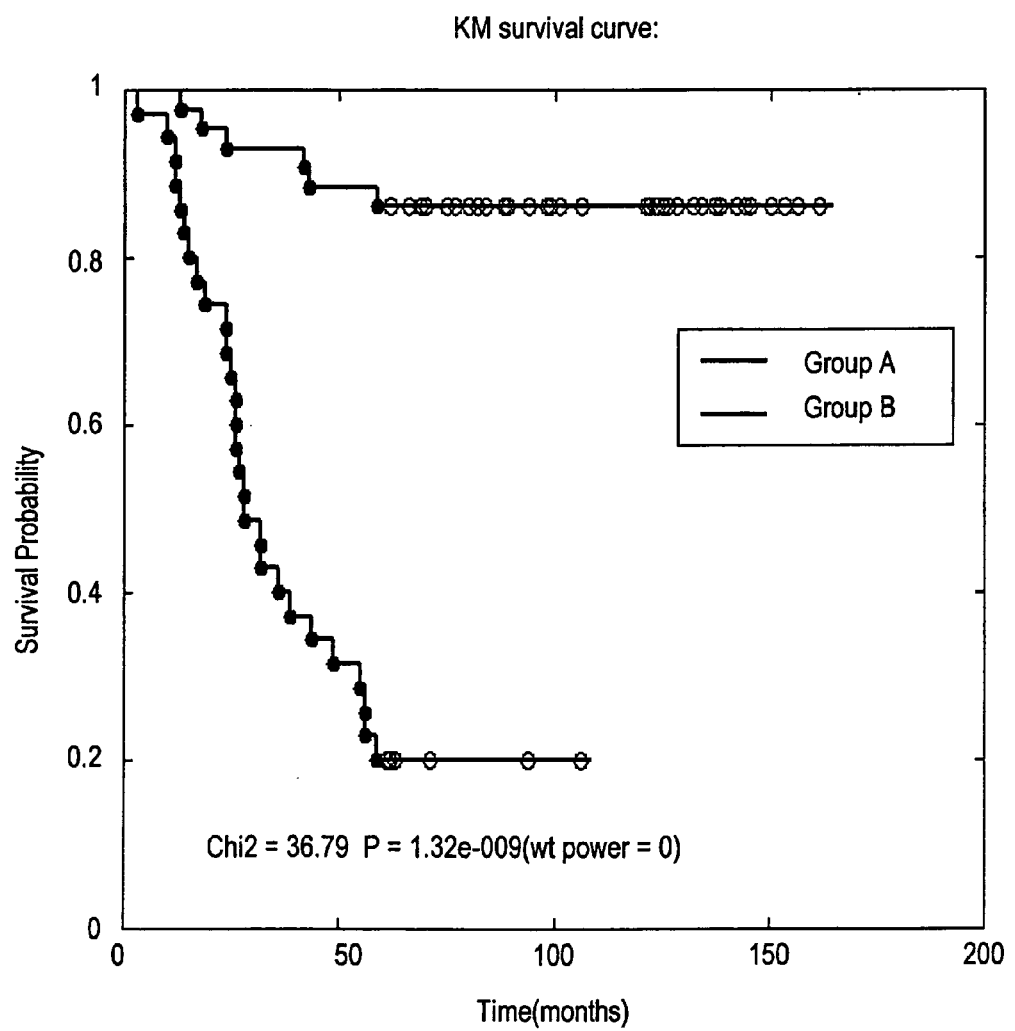

FIG. 16 The reoccurrence probability as a function of time since diagnosis. Group A and group B were predicted by using a leave-one-out method based on the optimal set of 70 discriminating marker genes. The 43 patients in group A consists of 37 patients from the no distant metastases group and 6 patients from the distant metastases group. The 35 patients in group B consists of 28 patients from the distant metastases group and 7 patients from the no distant metastases group.

Figure 17:
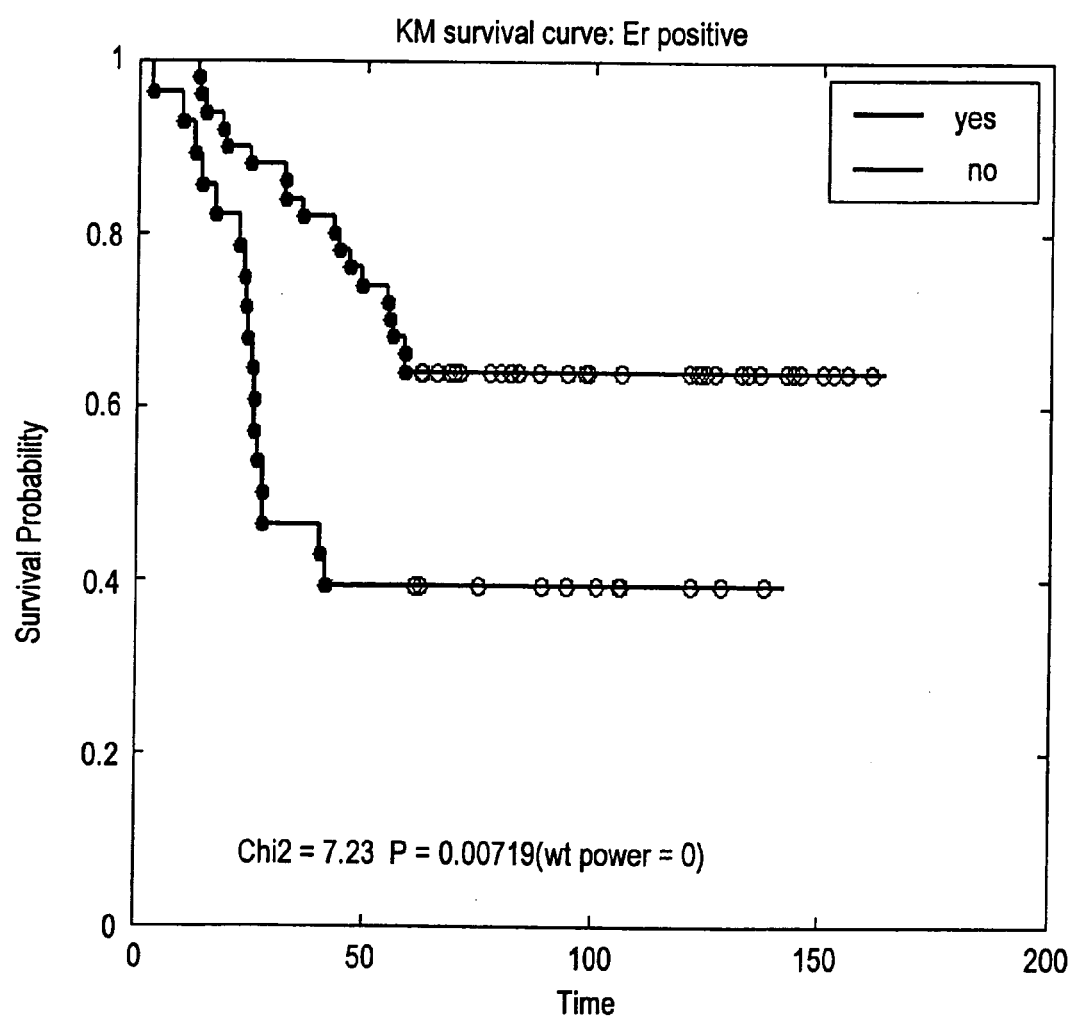

FIG. 17 The distant metastases probability as a function of time since diagnosis for ER(+) (yes) or ER(−) (no) individuals.

Figure 18:
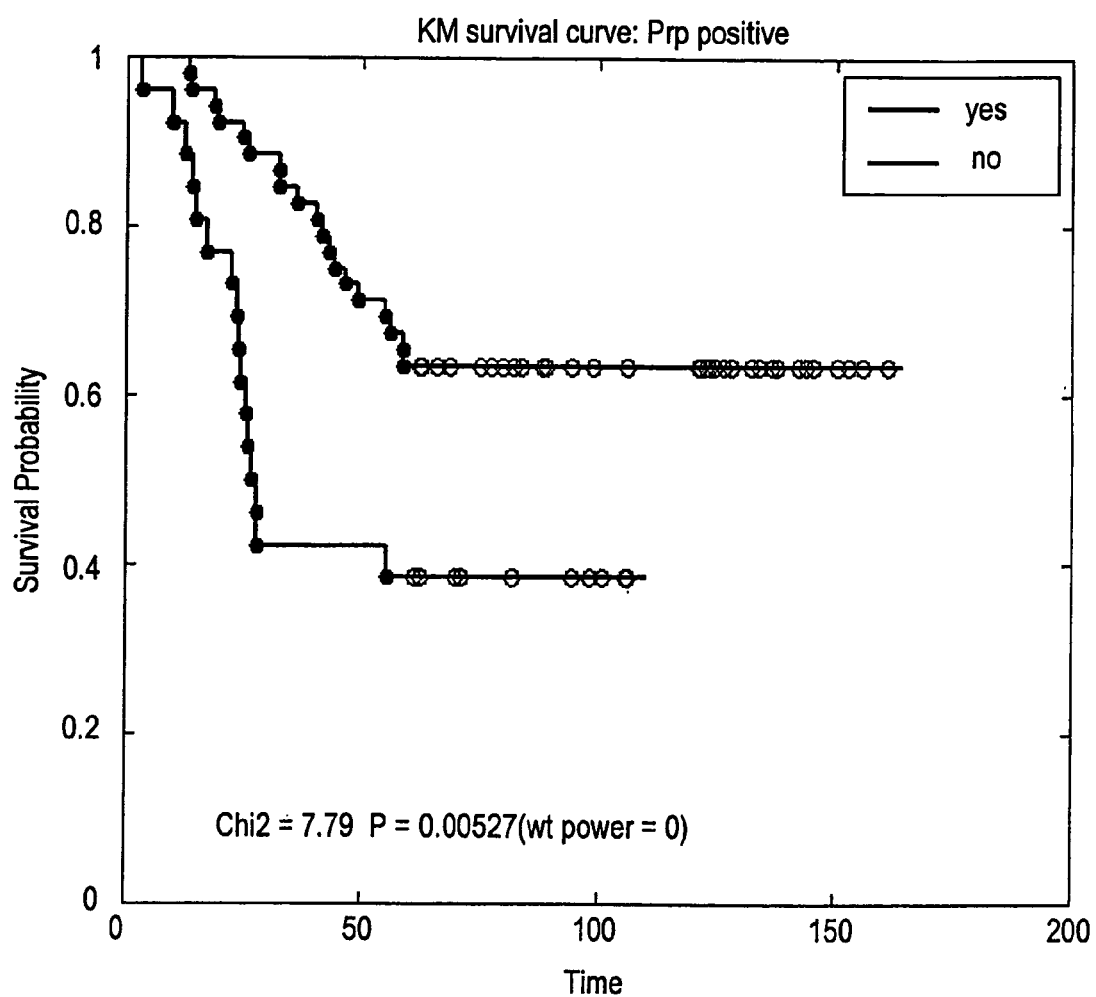

FIG. 18 The distant metastases probability as a function of time since diagnosis for progesterone receptor (PR)(+) (yes) or PR(−) (no) individuals.

Figure 19A:
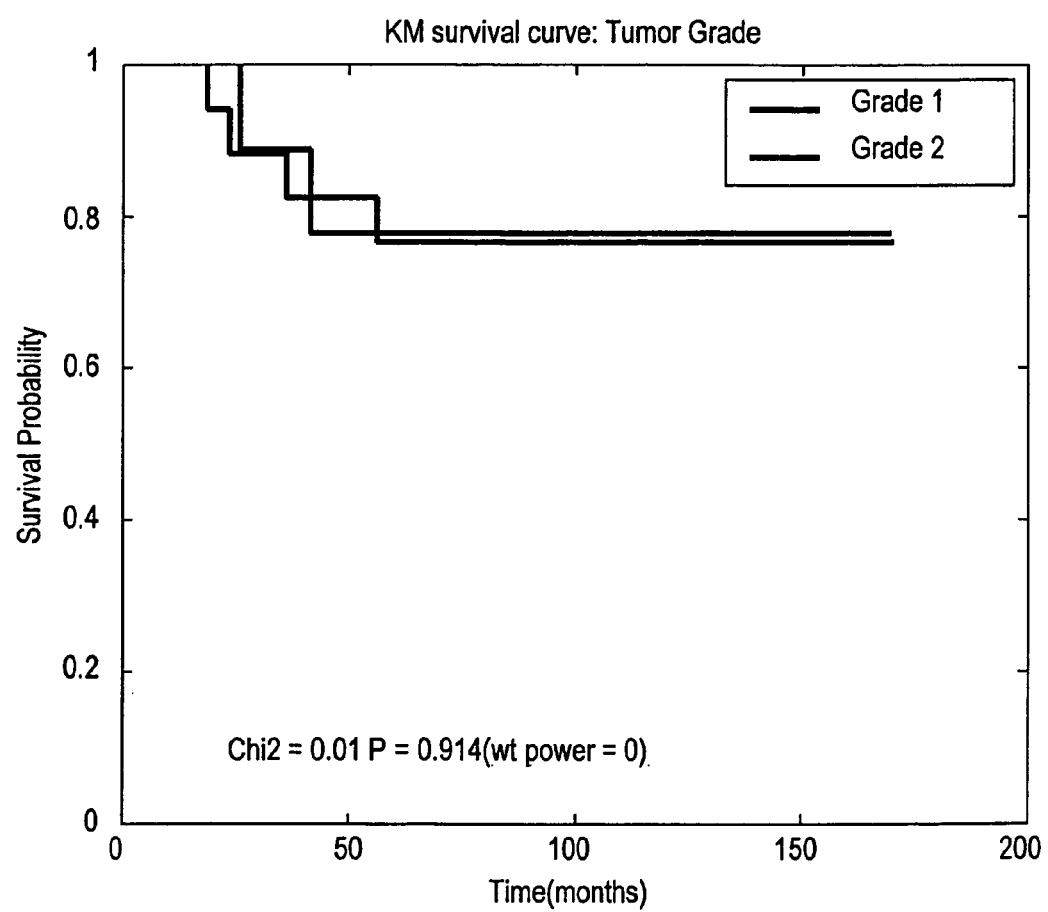

FIGS. 19A, B The distant metastases probability as a function of time since diagnosis. Groups were defined by the tumor grades.

Figure 20A:
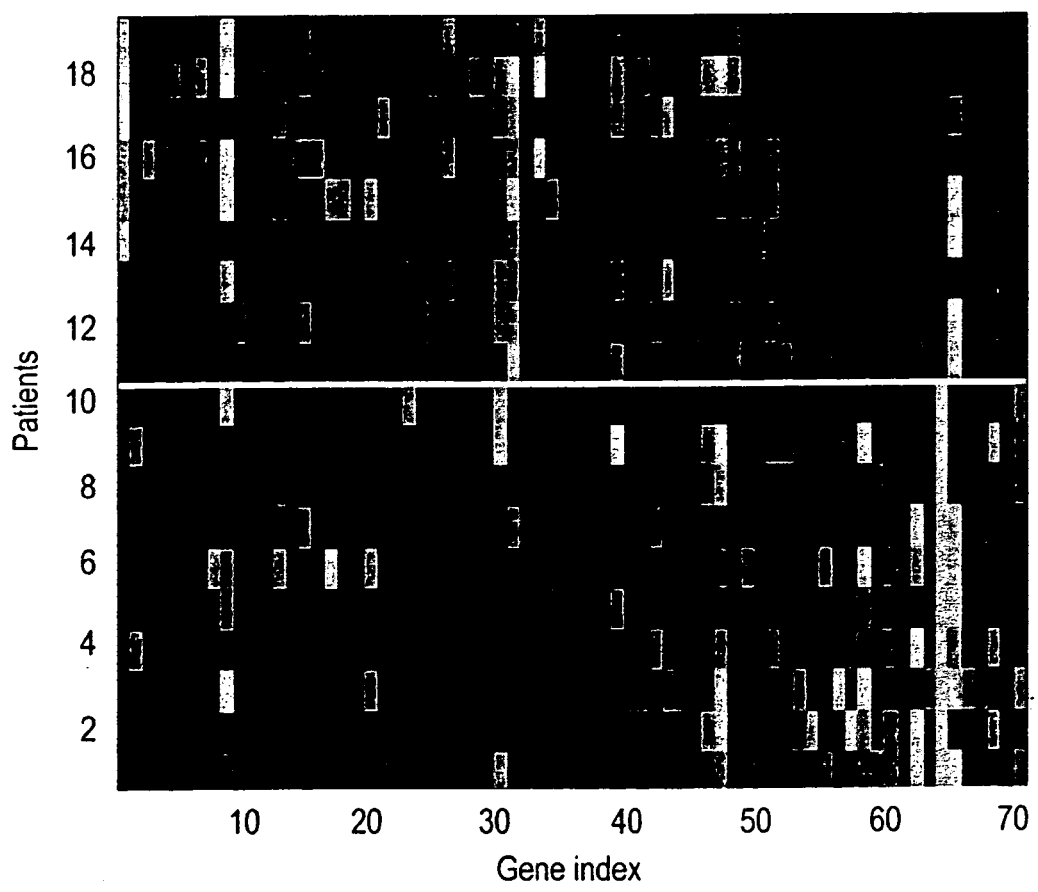

FIG. 20A Classification of 19 independent sporadic tumors into two prognostic groups, distant metastases and no distant metastases, using the 70 optimal marker genes. Patients above the white line have a good prognosis. Patients below the white line have a poor prognosis.

Figure 20B:
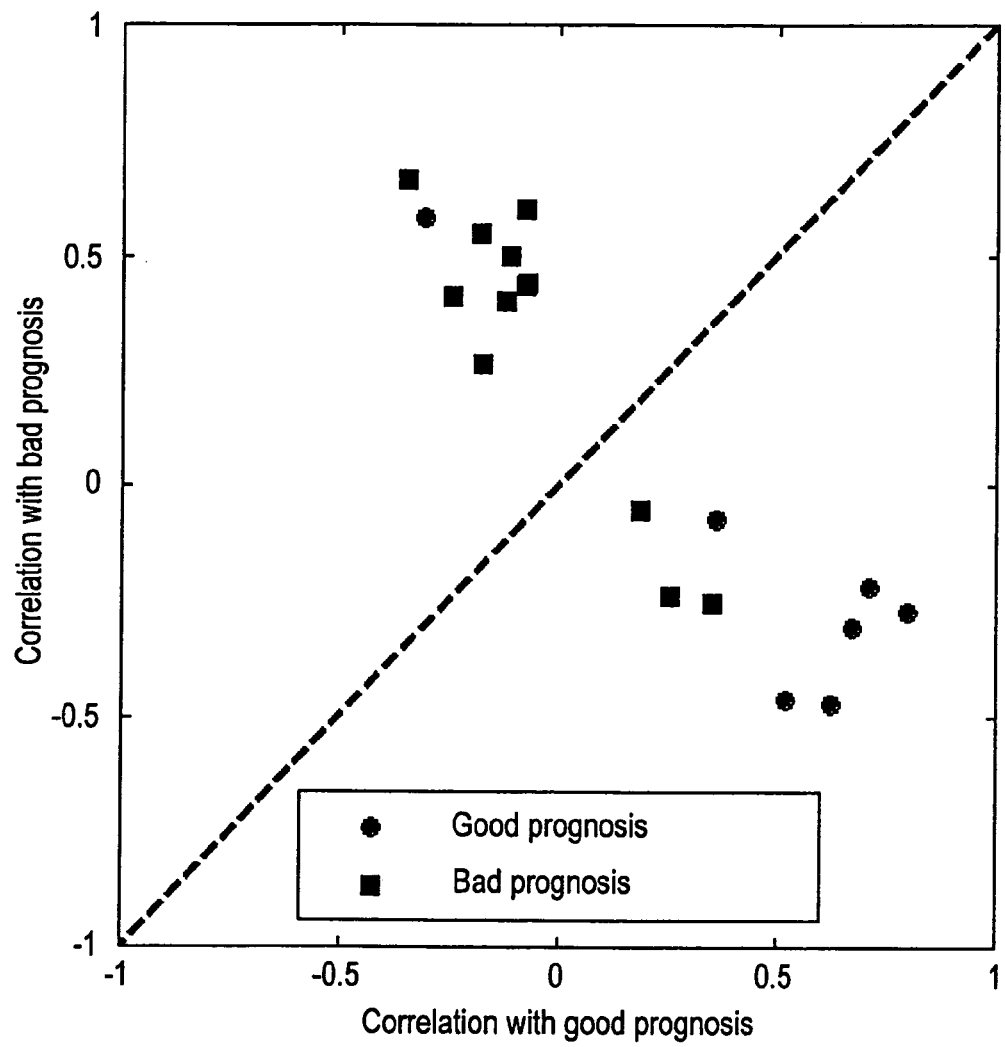

FIG. 20B Correlation between expression ratios of each patient and the average expression ratio of the good prognosis group is defined by the training set versus the correlation between expression ratios of each patient and the average expression ratio of the poor prognosis training set. Of nine patients in the good prognosis group, three are from the "distant metastases group"; of ten patients in the good prognosis group, one patient is from the "no distant metastases group". This error rate of 4 out of 19 is consistent with 13 out of 78 for the initial 78 patients.

Figure 20C:
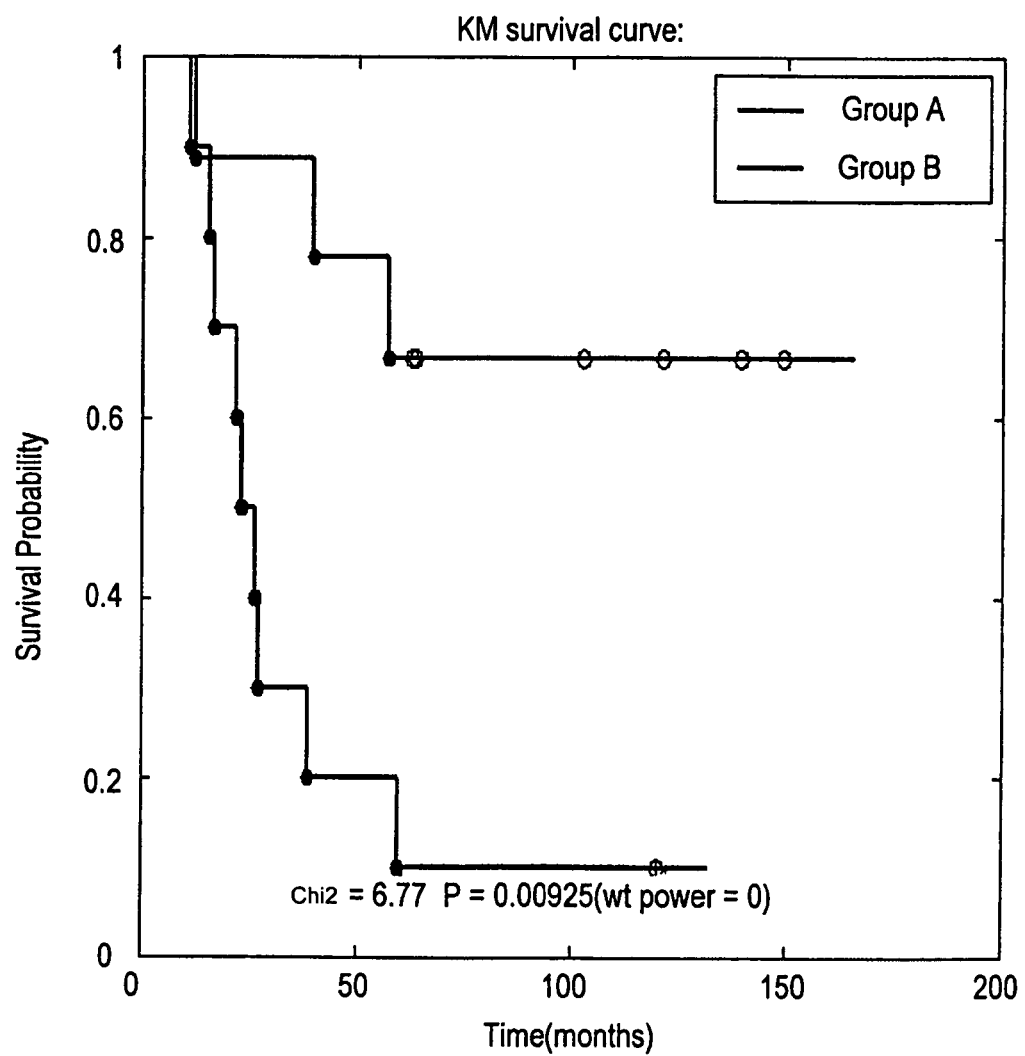

FIG. 20C The reoccurrence probability as a function of time since diagnosis for two groups predicted based on expression of the optimal 70 marker genes.

Figure 21A:
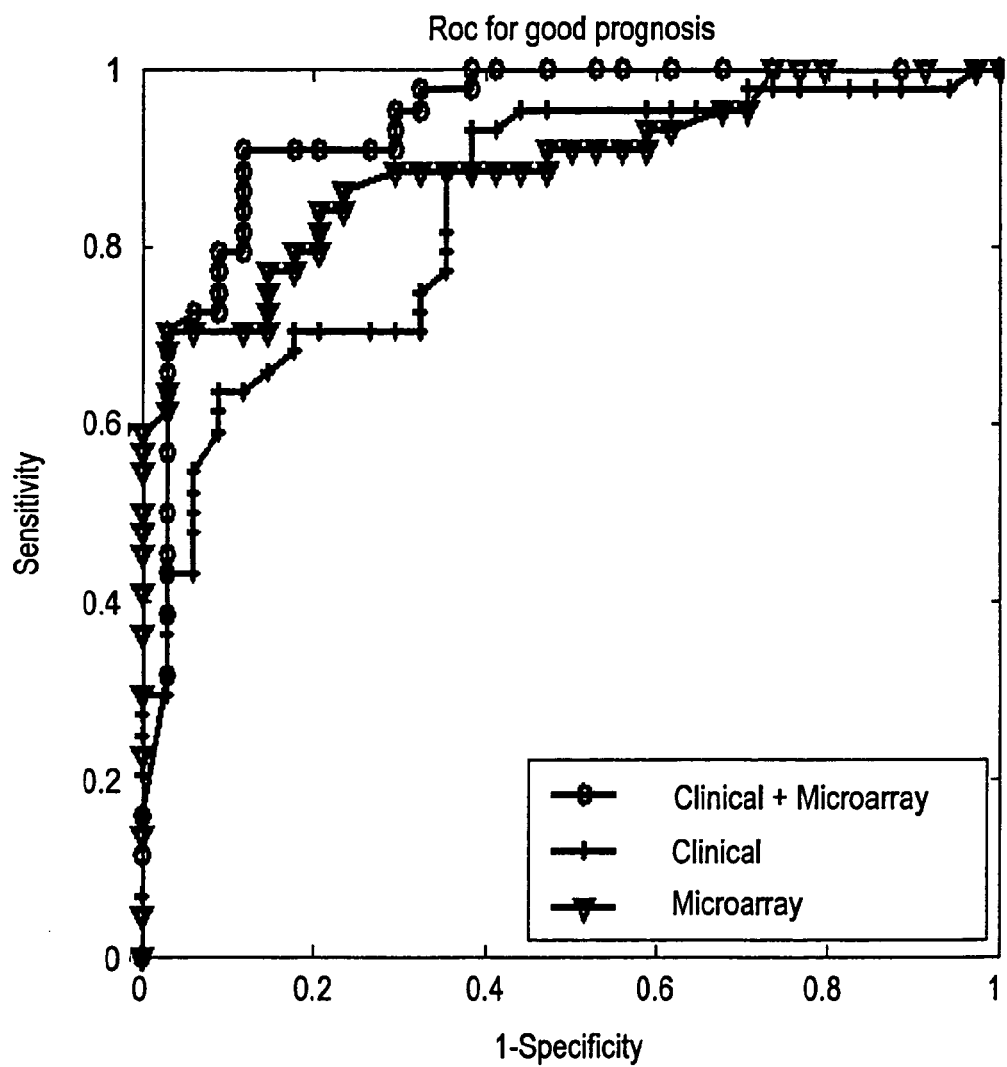

FIG. 21A Sensitivity vs. 1-specificity for good prognosis classification.

Figure 21B:
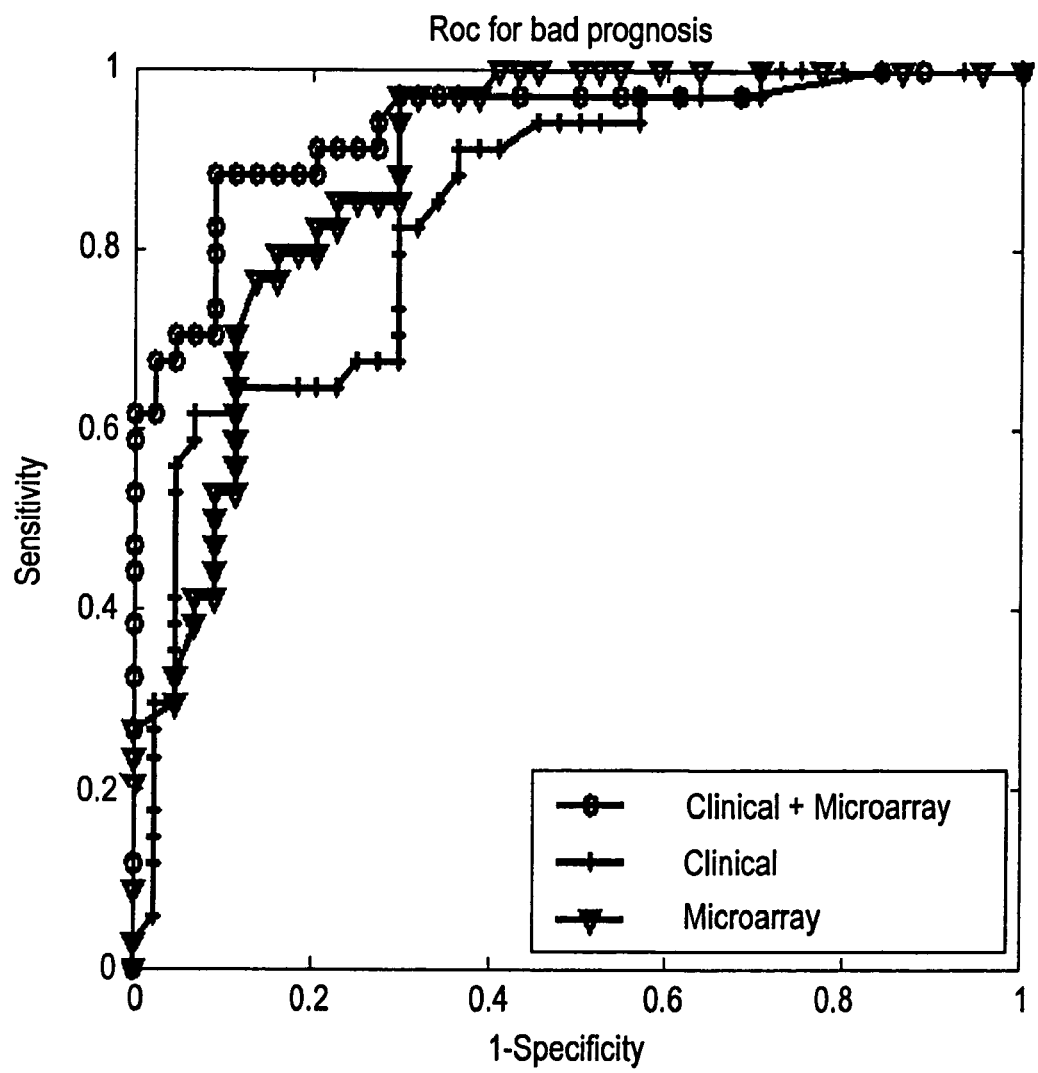

FIG. 21B Sensitivity vs. 1-specificity for poor prognosis classification.

Figure 21C:
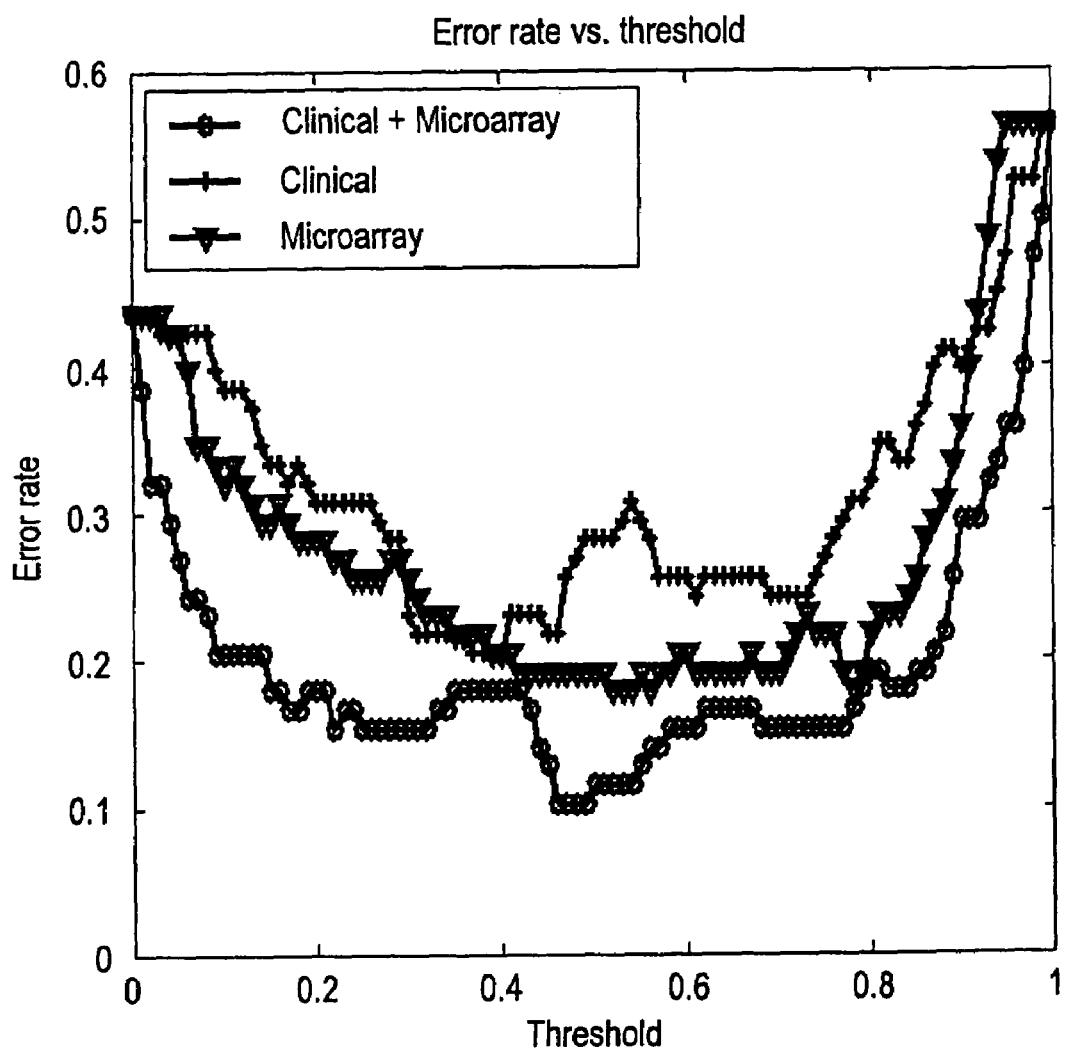

FIG. 21C Total error rate as a function of threshold on the modeled likelihood. Six clinical parameters (ER status, PR status, tumor grade, tumor size, patient age, and presence or absence of angioinvasion) were used to perform the clinical modeling.

Figure 22:
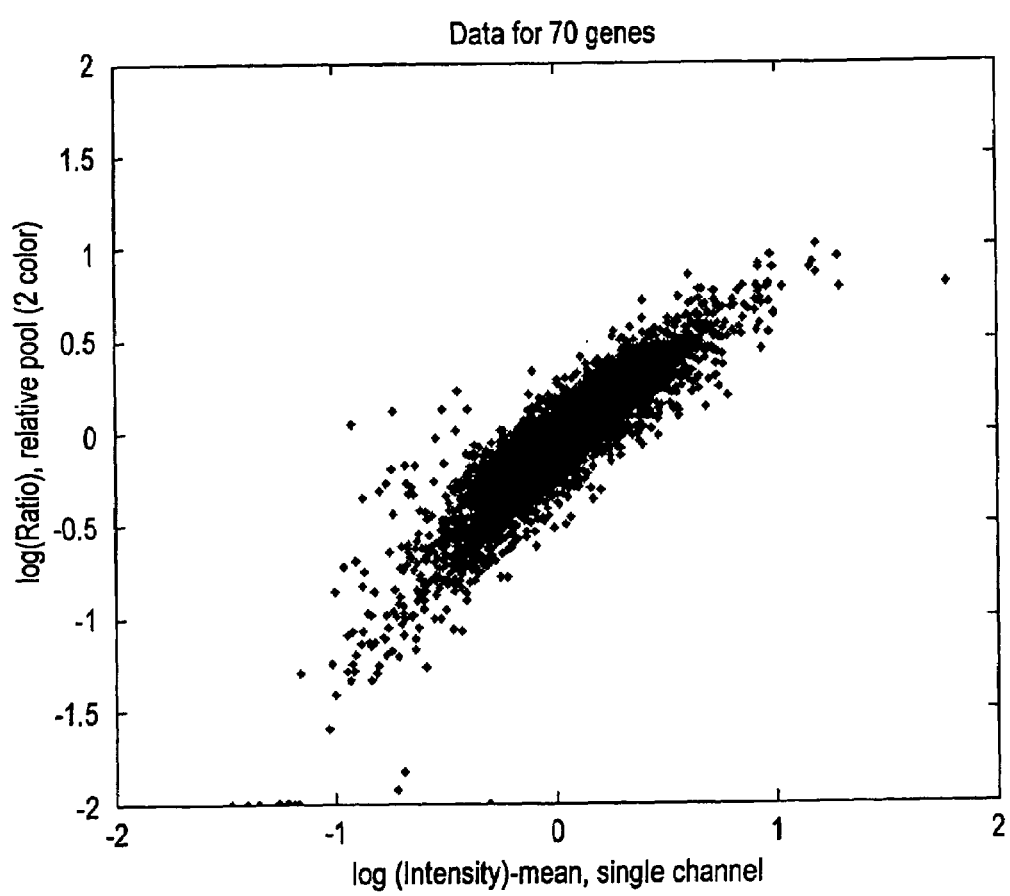

FIG. 22 Comparison of the log(ratio) of individual samples using the "material sample pool" vs. mean subtracted log(intensity) using the "mathematical sample pool" for 70 reporter genes in the 78 sporadic tumor samples. The "material sample pool" was constructed from the 78 sporadic tumor samples.

Figure 23A:
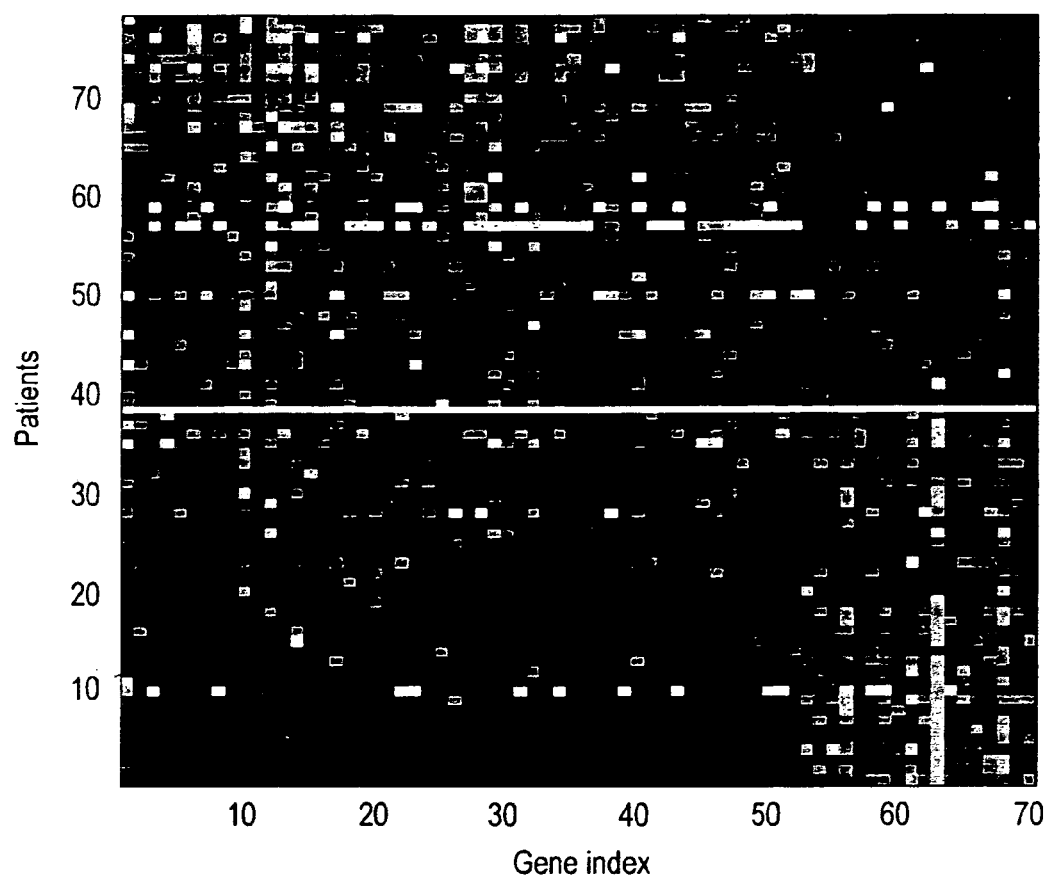

FIG. 23A Results of the "leave one out" cross validation based on single channel data. Samples are grouped according to each sample's coefficient of correlation to the average "good prognosis" profile and "poor prognosis" profile for the 70 genes examined. The white line separates samples from patients classified as having poor prognoses (below) and good prognoses (above).

Figure 23B:
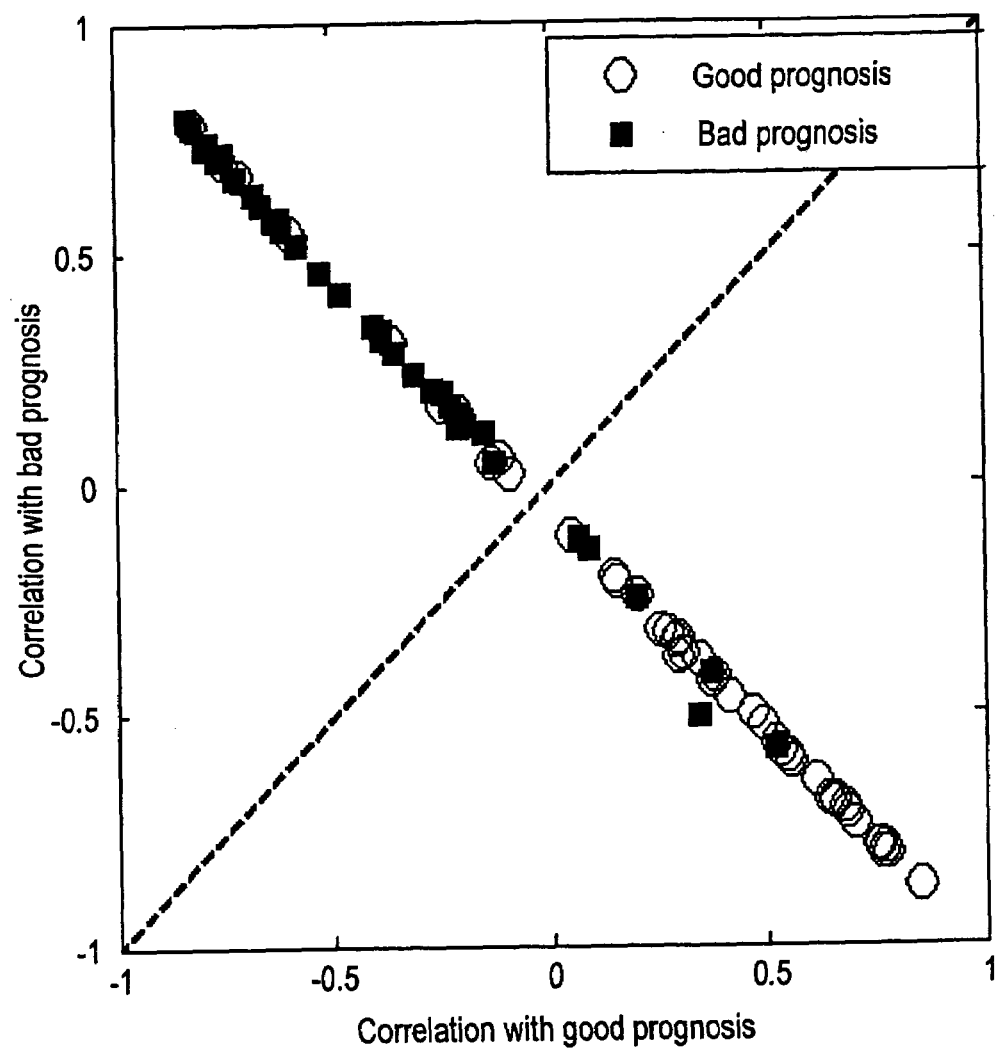

FIG. 23B Scatter plot of coefficients of correlation to the average expression in "good prognosis" samples and "poor prognosis" samples. The false positive rate (i.e., rate of incorrectly classifying a sample as being from a patient having a good prognosis as being one from a patient having a poor prognosis) was 10 out of 44, and the false negative rate is 6 out of 34.

Figure 24A:
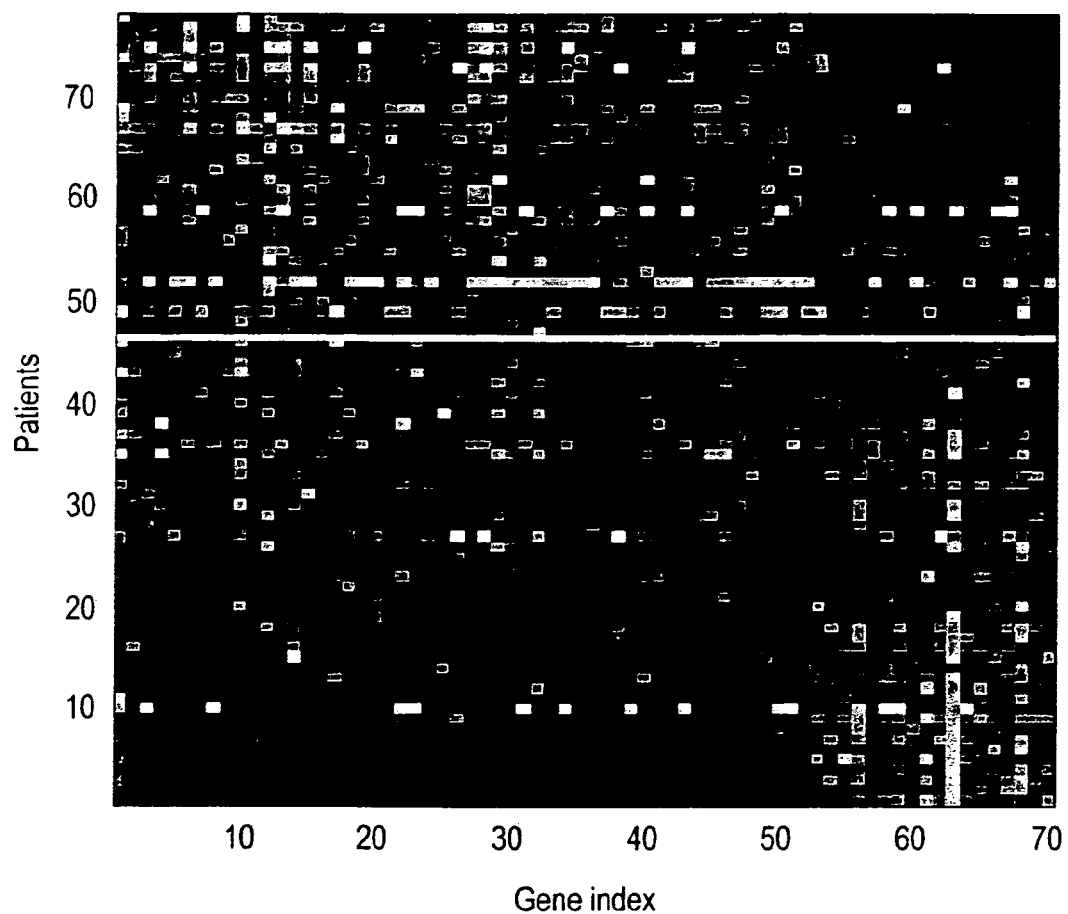

FIG. 24A Single-channel hybridization data for samples ranked according to the coefficients of correlation with the good prognosis classifier. Samples classified as "good prognosis" lie above the white line, and those classified as "poor prognosis" lie below.

Figure 24B:
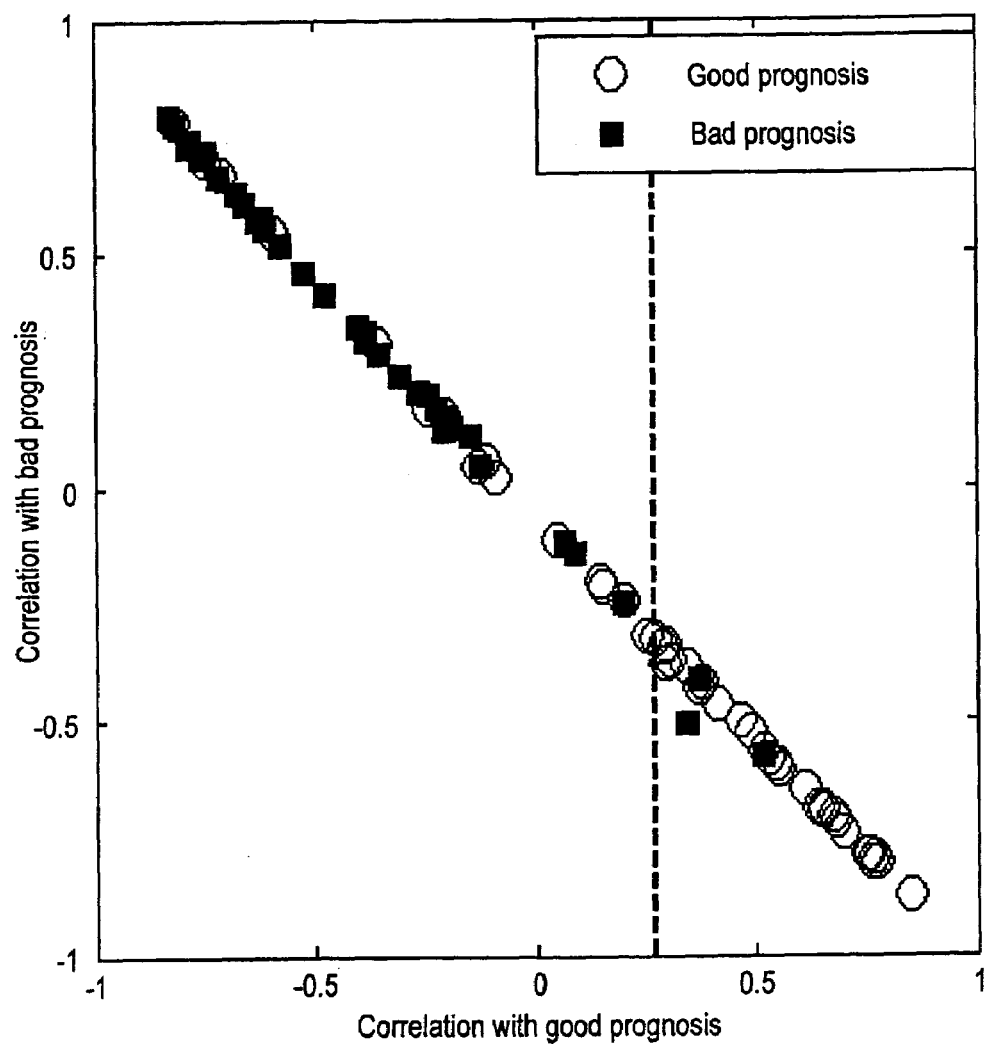

FIG. 24B Scatterplot of sample correlation coefficients, with three incorrectly classified samples lying to the right of the threshold correlation coefficient value. The threshold correlation value was set at 0.2727 to limit the false negatives to approximately 10% of the samples.

Figures 25A, 25B:
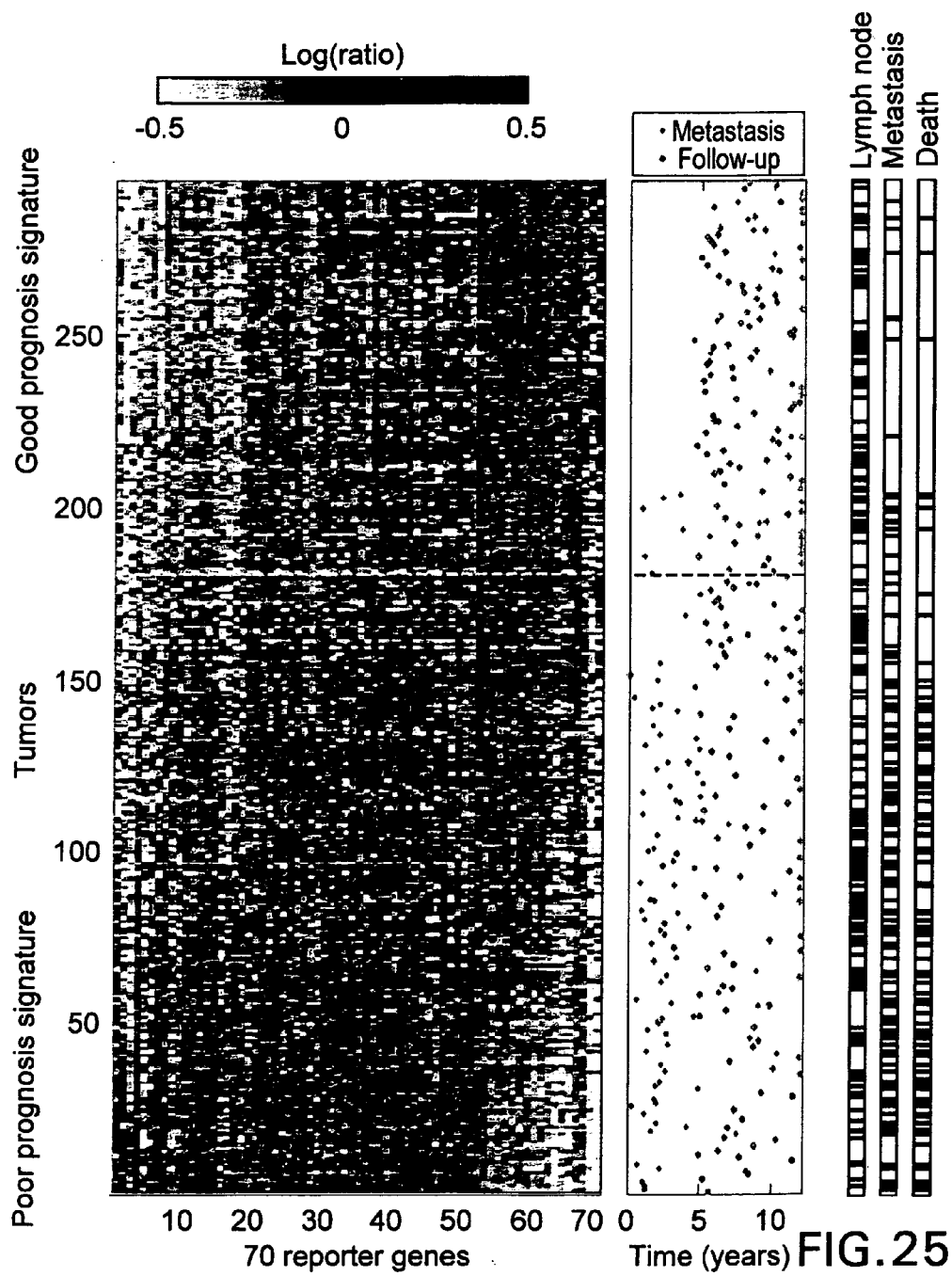

FIG. 25A Gene expression pattern of the 70 optimal prognosis marker genes (see Example 4) for a consecutive series of 295 breast carcinomas. Each row represents a prognostic profile of the 70 marker genes for one tumor and each column represents the relative expression abundance of one gene. Red indicates high mRNA expression in the tumor relative to the reference mRNA (pooled mRNA from all tumor samples); green indicates low expression relative to the reference mRNA. The horizontal dotted line is the previously determined separation between good and poor prognosis signature subgroups. Tumors are rank-ordered according to their correlation with the average profile in tumors of good prognosis patients (C1); the most highly correlated tumors lie at the top of the plot.

FIG. 25B Time in years to distant metastases as a first event (red dots) or the time of follow-up for all other patients (blue dots).

FIG. 25C Selected clinical characteristics: lymph node status (blue=pN+, white=pN0); metastases as first event (blue=yes, white=no); death (blue=yes, white=no).

Figure 26A:
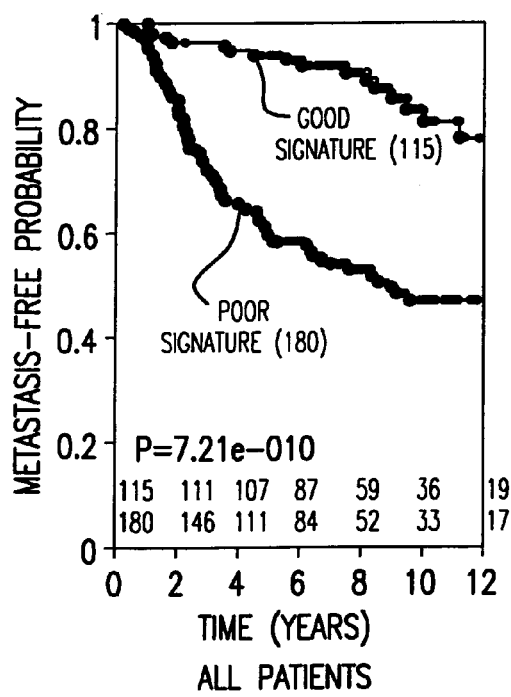
Figure 26B:
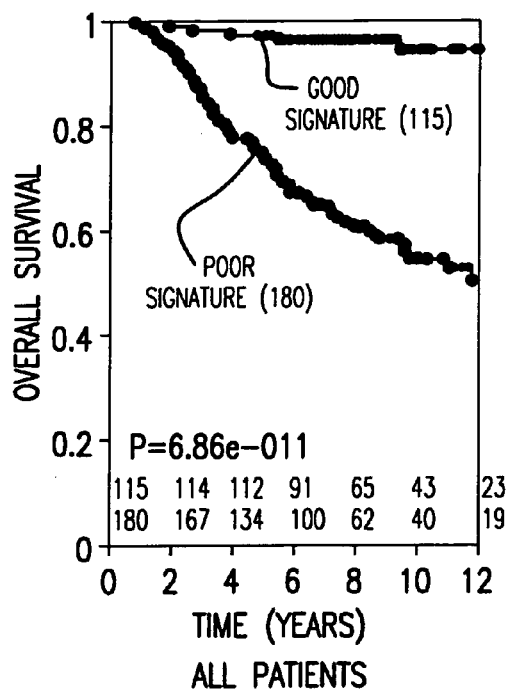
Figure 26C:
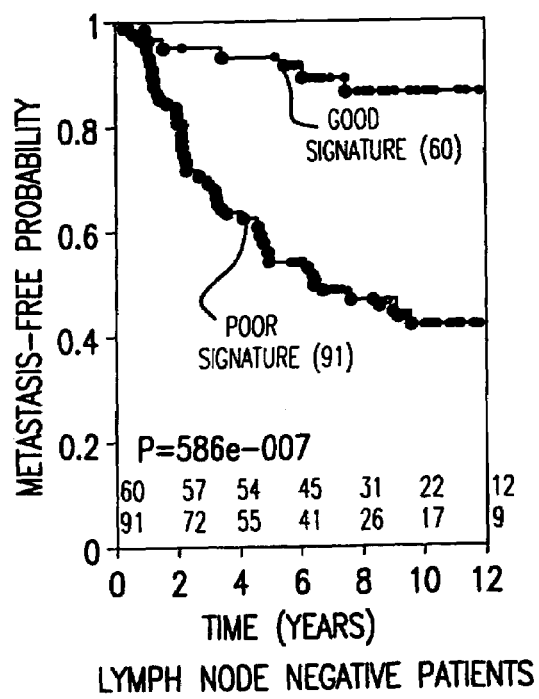
Figure 26D:
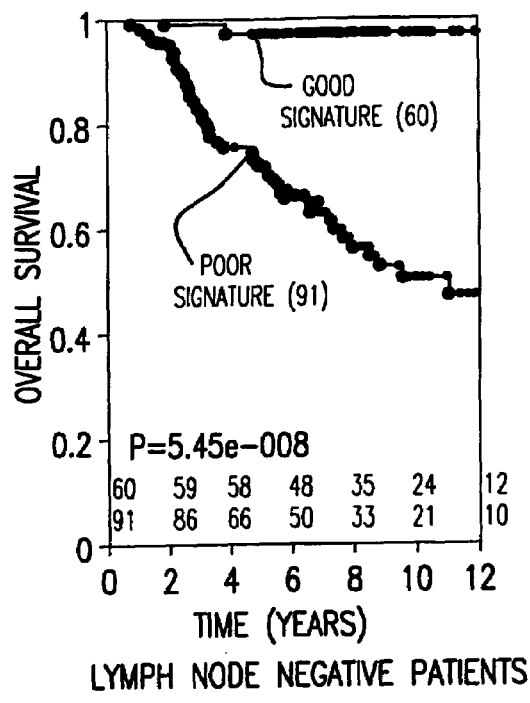
Figure 26E:
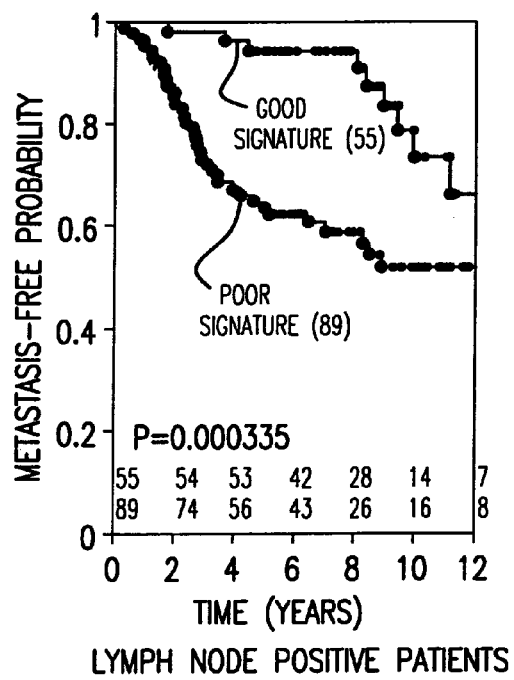
Figure 26F:
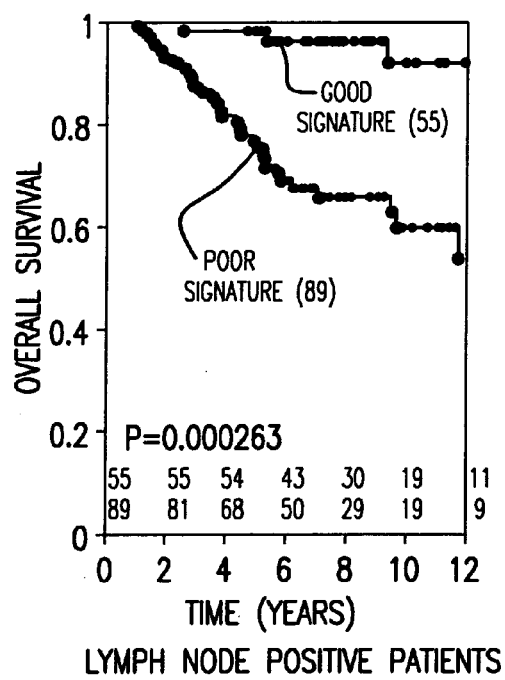

FIGS. 26A–26F Kaplan-Meier plots for the cohort of 295 breast cancer patients. FIG. 26A shows the metastasis-free probability of all 295 patients according to "good prognosis" (n=115, upper line) and "poor prognosis" (n=180, lower line) signature. FIG. 26B shows the overall survival of all 295 patients according to "good prognosis" and "poor prognosis" signature. FIG. 26C shows the metastasis-free probability of lymph node negative patients within the 295 tumor cohort. FIG. 26D shows the overall survival of lymph node negative patients. FIG. 26E shows the metastasis-free probability for lymph node positive patients. FIG. 26F shows the overall survival of lymph node positive patients. For each of the plots, the number of patients who are metastasis-free (FIGS. 26A, C, E) or have survived (FIGS. 26B, D, F), and for whom information is available, at each time point (years) are indicated for "good signature" patients (upper line; upper row of numbers) or "poor signature" patients (lower line; lower row of numbers). For each plot, P indicates the P-value of the log-rank test.

Figure 27A:
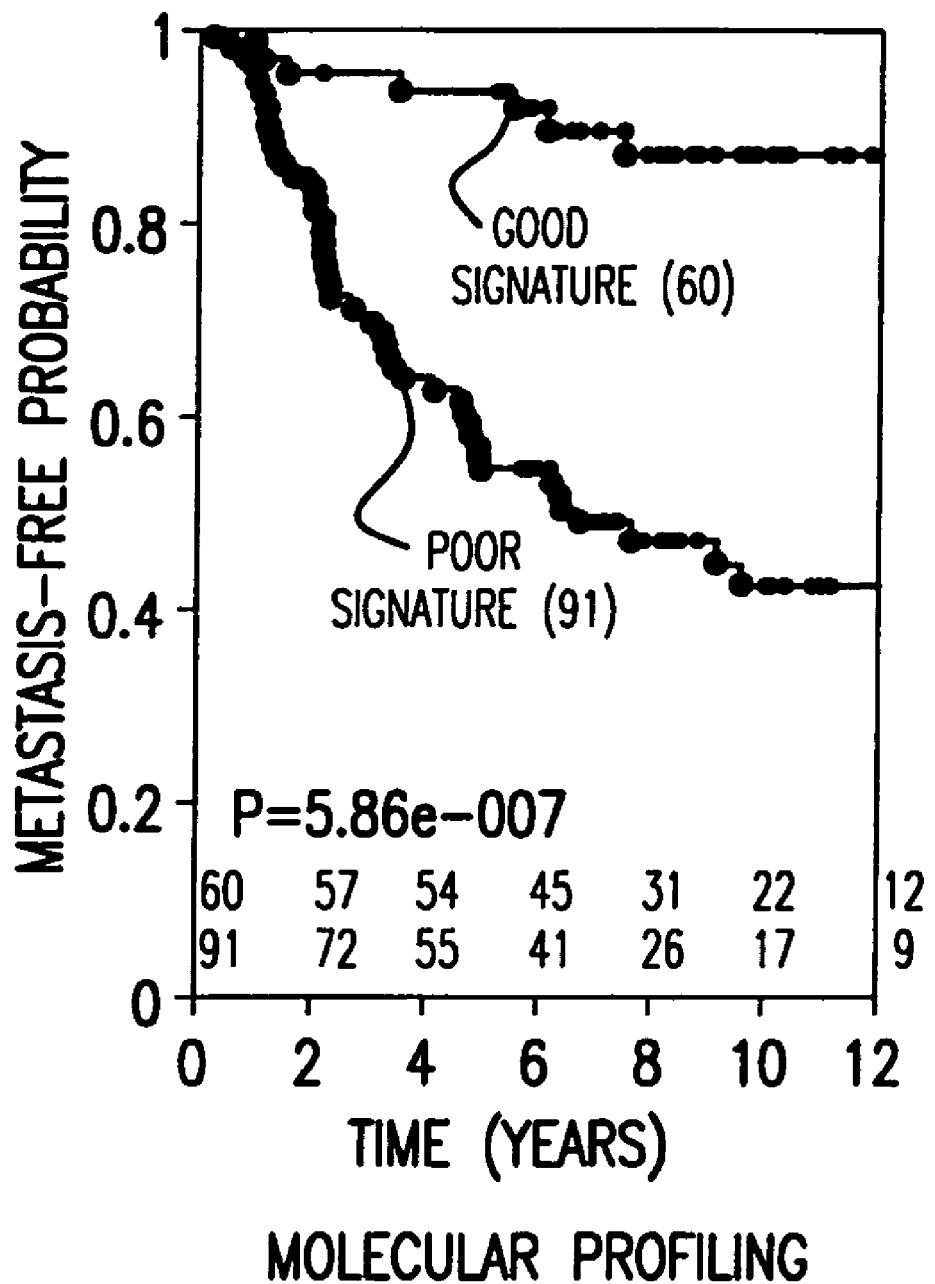
Figure 27B:
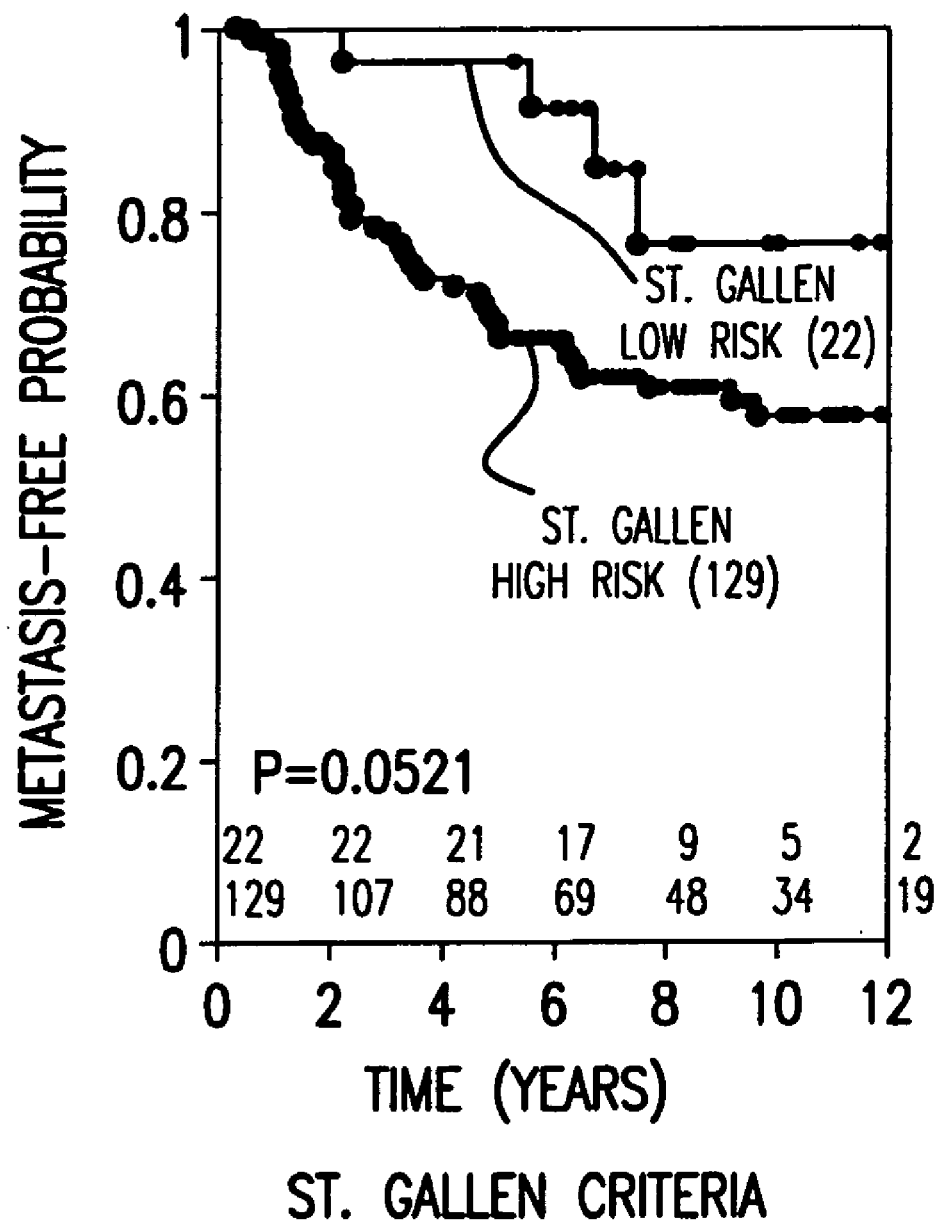
Figure 27C:
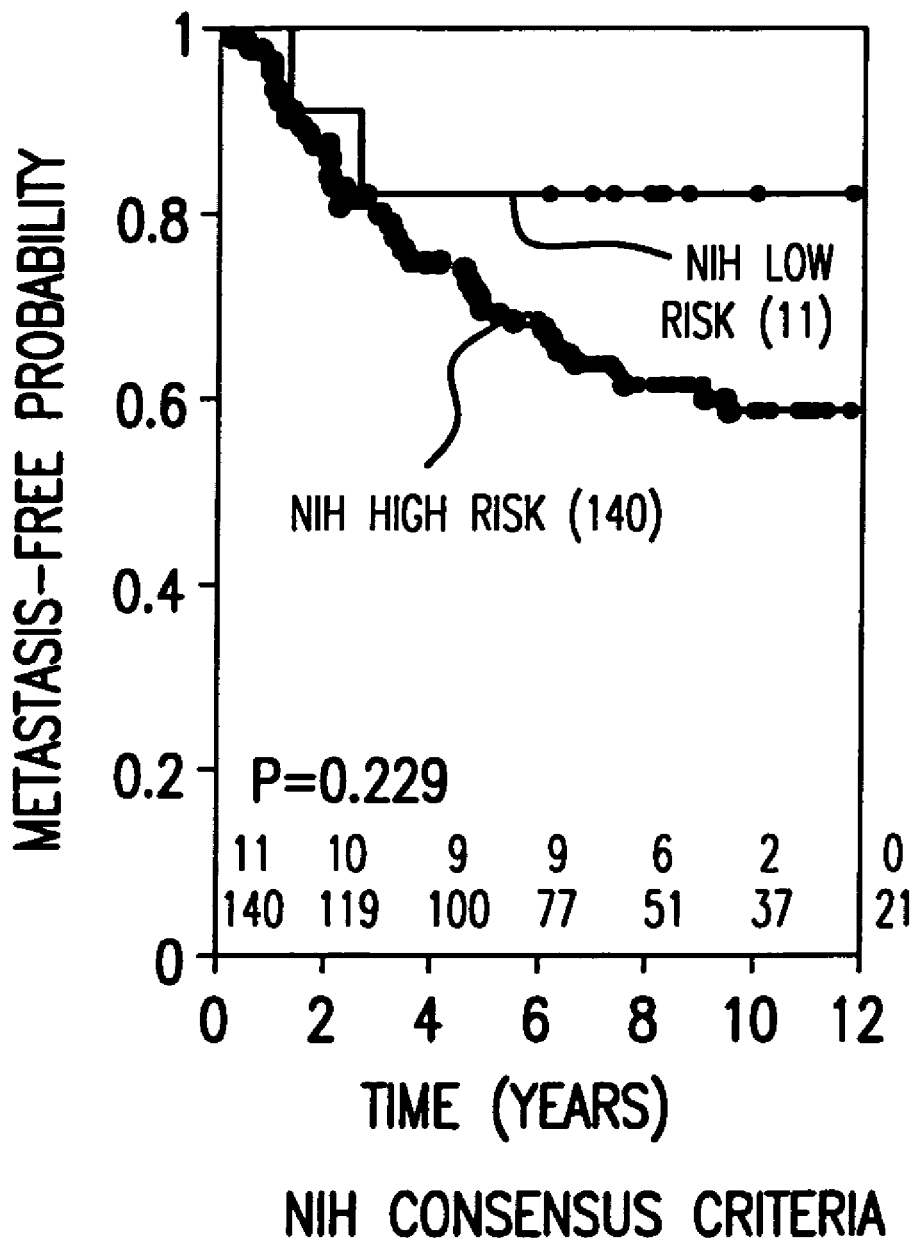
Figure 27D:
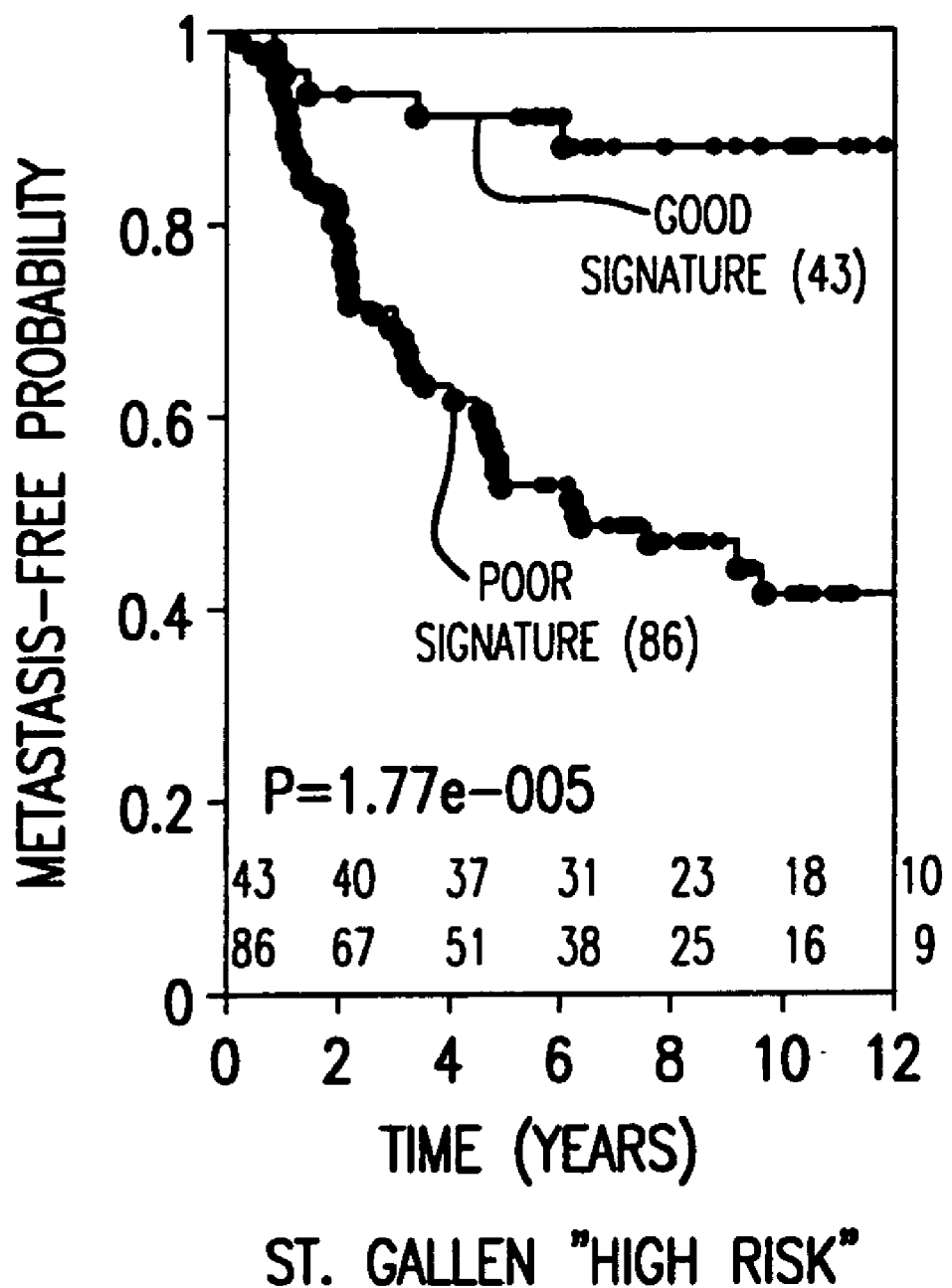
Figure 27E:
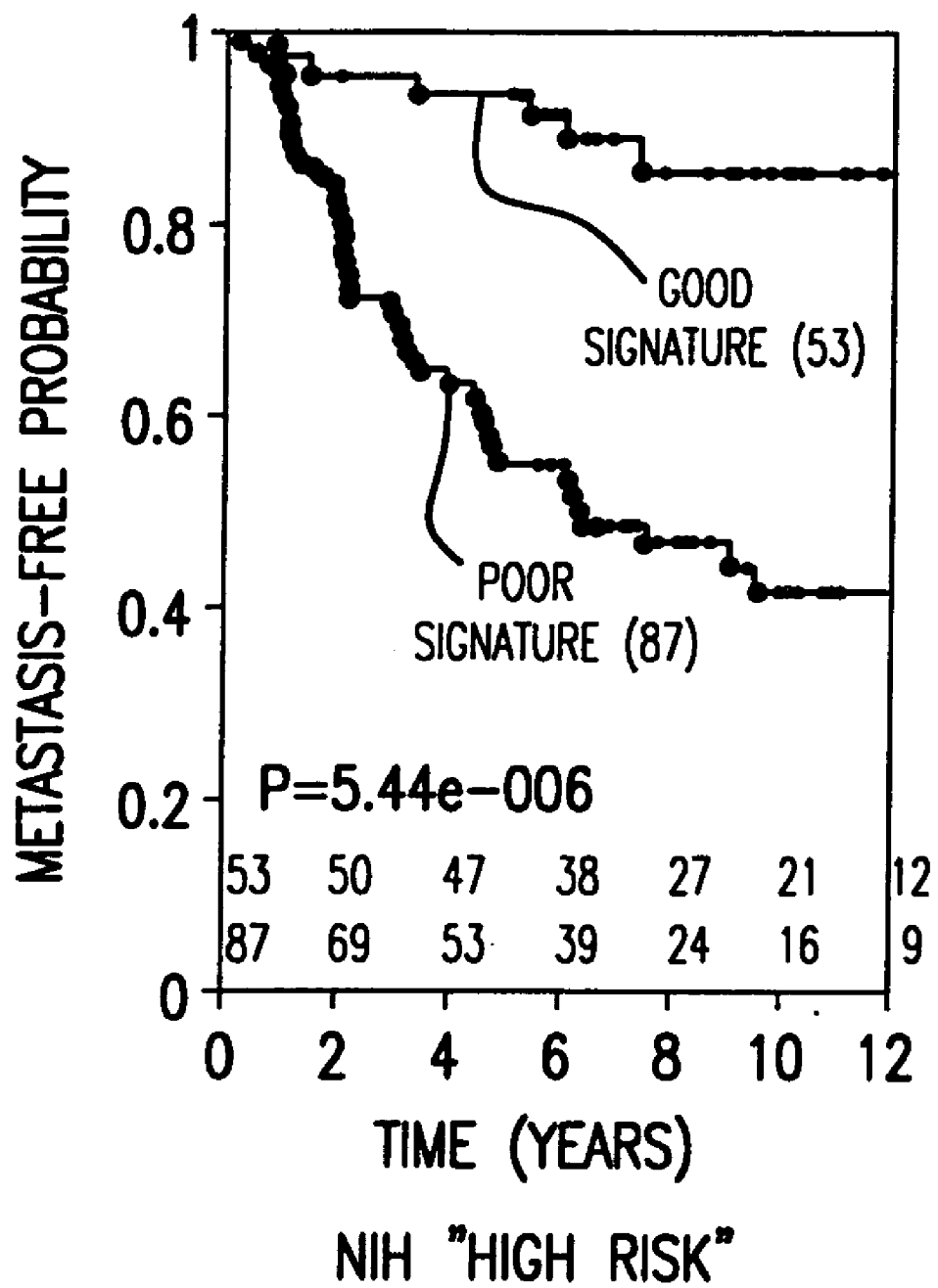
Figure 27F:
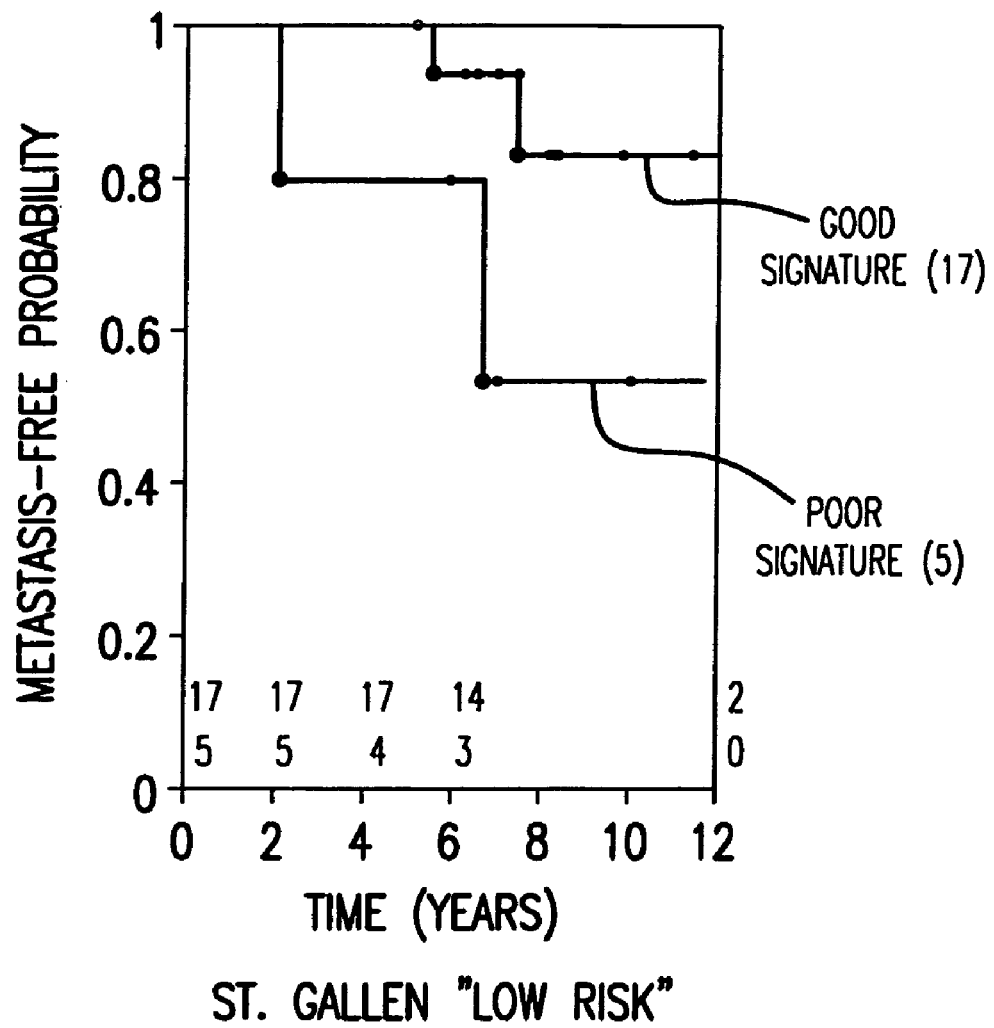
Figure 27G:
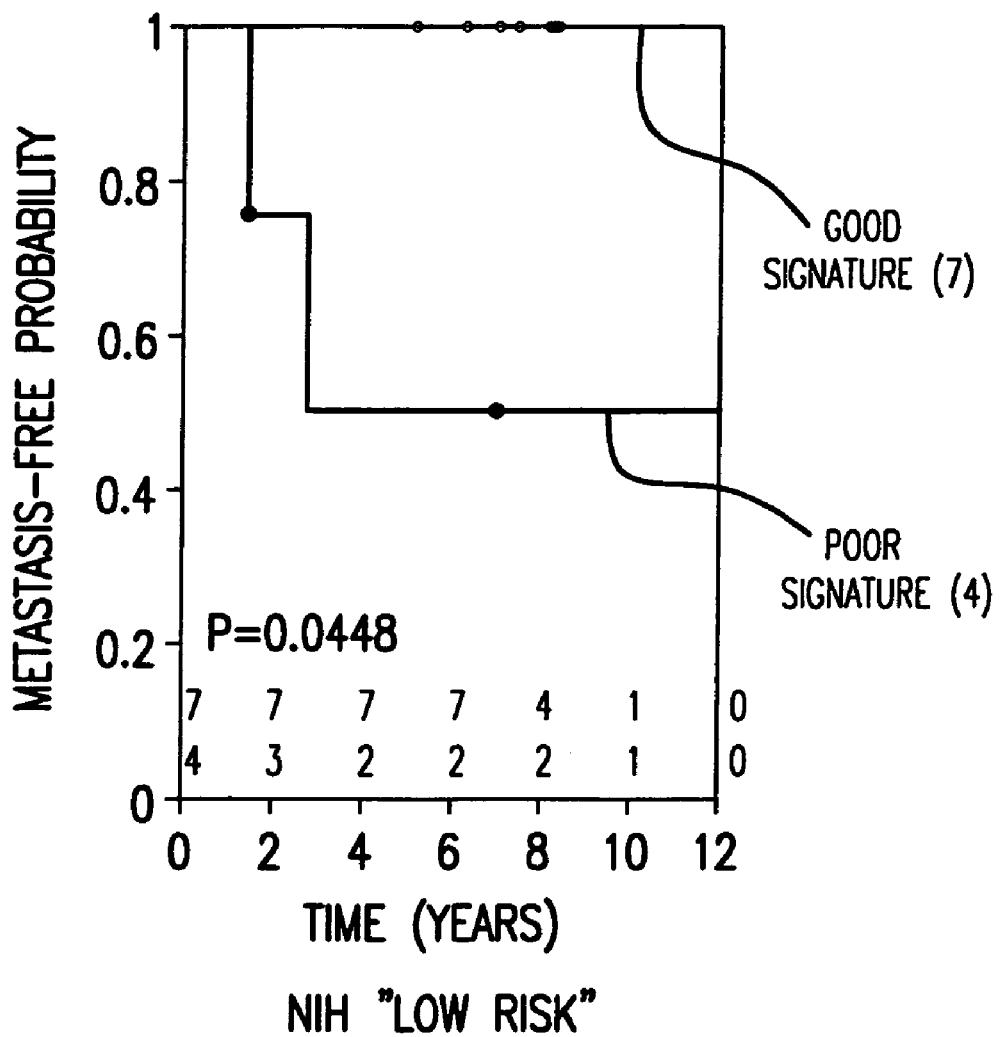

FIGS. 27A–27G Kaplan-Meier plots of the metastasis-free probabilities for 151 lymph node negative breast cancer patients within the 295 tumor cohort. FIG. 27A shows the metastasis-free probabilities of the "good prognosis" and "poor prognosis" groups as identified by molecular profiling using the 70 optimal marker genes (i.e., "good prognosis" and "poor prognosis" signatures; see Example 4). FIG. 27B shows the metastasis-free probabilities of "low-risk" and "high-risk" groups as identified by "St. Gallen" criteria. FIG. 27C shows the metastasis-free probabilities of "low-risk" and "high-risk" signature groups as identified by "NIH consensus" criteria. FIG. 27D shows the "St. Gallen" "high-risk" group (n=129) divided into "good prognosis" and "poor prognosis" signature groups by profiling. FIG. 27E shows the "NIH" "high-risk" group (n=140) divided into "good prognosis" and "poor prognosis" signature groups by profiling. FIG. 27F shows the "St. Gallen" "low-risk" group (n=22) divided into "good prognosis" and "poor prognosis" signature groups by profiling. FIG. 27G shows the "NIH" "low-risk" group (n=11) divided into "good prognosis" and "poor prognosis" signature groups by profiling. Patients at risk at each time point (years; see description of FIG. 26) are indicated in each plot for "good signature" patients (upper line; upper row of numbers) or "poor signature" patients (lower line; lower row of numbers). P indicates the P-value of the log-rank test.

Figure 28A:
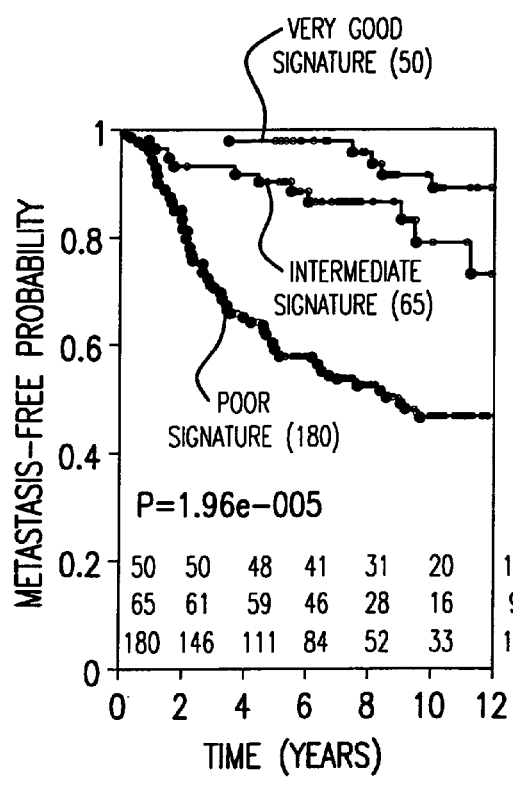
Figure 28B:
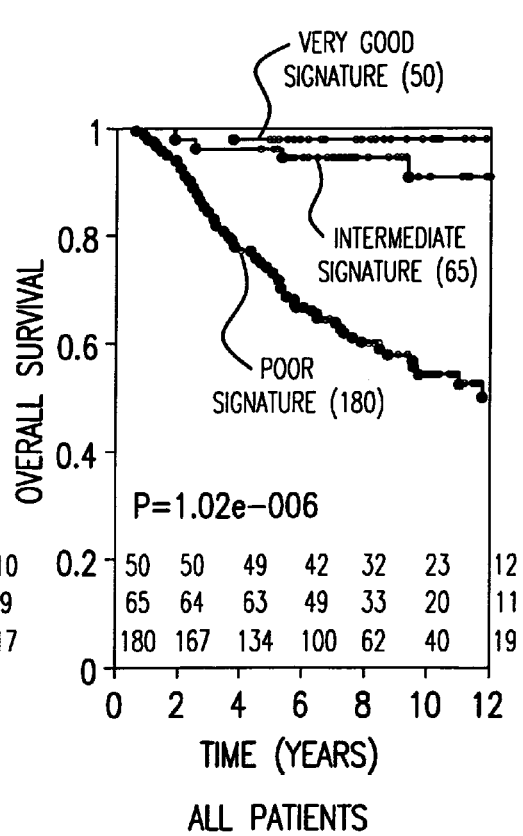
Figure 28C:
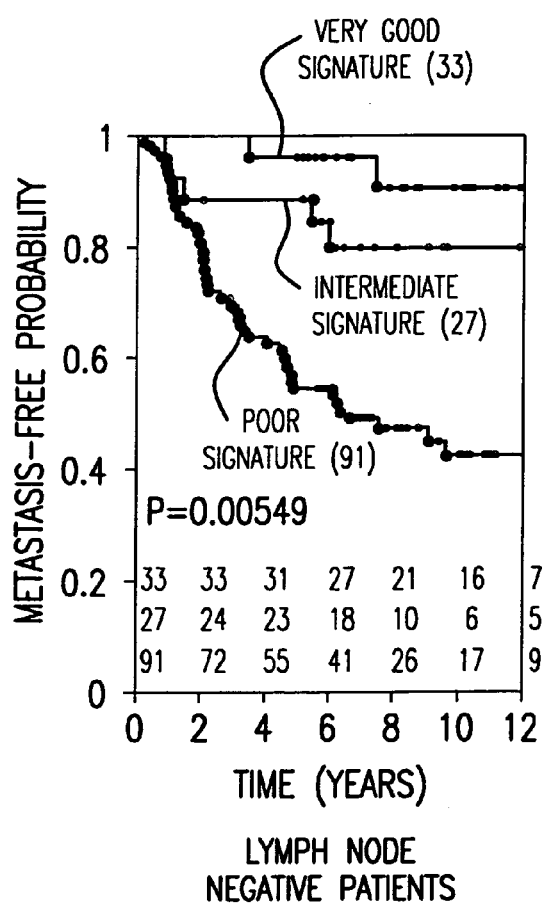
Figure 28D:
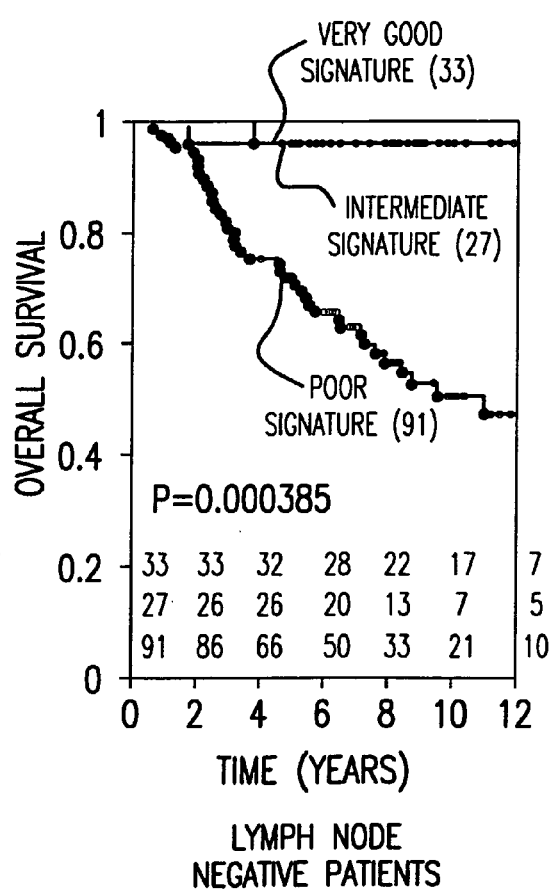

FIGS. 28A–28F Kaplan Meier plots for 295 breast cancer patients classified into "very good prognosis," "intermediate prognosis," and "poor prognosis" groups. FIG. 28A shows the metastasis-free probability of all 295 patients according to "very good", "intermediate" and "poor prognosis" signature. FIG. 27B shows the overall survival of all 295 patients according to "very good," "intermediate," and "poor prognosis" signature. FIG. 27C shows the metastasis-free probability for lymph node negative patients similarly classified. FIG. 27D shows the overall survival for lymph node negative patients so classified. FIG. 27E shows the metastasis-free probability for lymph node positive patients so classified. FIG. 27F shows the overall survival of lymph node positive patients so classified. Patients at risk at each time point (years; see description of FIG. 26) are indicated in each plot for "very good" signature patients (top line; top row of numbers), "intermediate" signature patients (middle line; middle row of numbers) or "poor prognosis" signature patients (bottom line; bottom row of numbers) patients. P indicates the P-value of the log-rank test.

5. DETAILED DESCRIPTION OF THE INVENTION

5.1 Introduction

The invention relates to sets of genetic markers whose expression patterns correlate with important characteristics of breast cancer tumors. i.e., estrogen receptor (ER) status, BRCA1 status, and the likelihood of relapse (i.e., distant metastasis or poor prognosis). More specifically, the invention provides for sets of genetic markers that can distinguish the following three clinical conditions. First, the invention relates to sets of markers whose expression correlates with the ER status of a patient, and which can be used to distinguish ER(+) from ER(−) patients. ER status is a useful prognostic indicator, and an indicator of the likelihood that a patient will respond to certain therapies, such as tamoxifen. Also, among women who are ER positive the response rate (over 50%) to hormonal therapy is much higher than the response rate (less 10%) in patients whose ER status is negative. In patients with ER positive tumors the possibility of achieving a hormonal response is directly proportional to the level ER (P. Calabresi and P. S. Schein, MEDICAL ONCOLOGY (2ND ED.), McGraw-Hill, Inc., New York (1993)). Second, the invention further relates to sets of markers whose expression correlates with the presence of BRCA1 mutations, and which can be used to distinguish BRCA1-type tumors from sporadic tumors. Third, the invention relates to genetic markers whose expression correlates with clinical prognosis, and which can be used to distinguish patients having good prognoses (i.e., no distant metastases of a tumor within five years) from poor prognoses (i.e., distant metastases of a tumor within five years). Methods are provided for use of these markers to distinguish between these patient groups, and to determine general courses of treatment. Microarrays comprising these markers are also provided, as well as methods of constructing such microarrays. Each markers correspond to a gene in the human genome, i.e., such marker is identifiable as all or a portion of a gene. Finally, because each of the above markers correlates with a certain breast cancer-related conditions, the markers, or the proteins they encode, are likely to be targets for drugs against breast cancer.

5.2 Definitions

As used herein, "BRCA1 tumor" means a tumor having cells containing a mutation of the BRCA1 locus.

The "absolute amplitude" of correlation expressions means the distance, either positive or negative, from a zero value; i.e., both correlation coefficients −0.35 and 0.35 have an absolute amplitude of 0.35.

"Status" means a state of gene expression of a set of genetic markers whose expression is strongly correlated with a particular phenotype. For example, "ER status" means a state of gene expression of a set of genetic markers whose expression is strongly correlated with that of ESR1 (estrogen receptor gene), wherein the pattern of these genes' expression differs detectably between tumors expressing the receptor and tumors not expressing the receptor.

"Good prognosis" means that a patient is expected to have no distant metastases of a breast tumor within five years of initial diagnosis of breast cancer.

"Poor prognosis" means that a patient is expected to have distant metastases of a breast tumor within five years of initial diagnosis of breast cancer.

"Marker" means an entire gene, or an EST derived from that gene, the expression or level of which changes between certain conditions. Where the expression of the gene correlates with a certain condition, the gene is a marker for that condition.

"Marker-derived polynucleotides" means the RNA transcribed from a marker gene, any cDNA or cRNA produced therefrom, and any nucleic acid derived therefrom, such as synthetic nucleic acid having a sequence derived from the gene corresponding to the marker gene.

A "similarity value" is a number that represents the degree of similarity between two things being compared. For example, a similarity value may be a number that indicates the overall similarity between a patient's expression profile using specific phenotype-related markers and a control specific to that phenotype (for instance, the similarity to a "good prognosis" template, where the phenotype is a good prognosis). The similarity value may be expressed as a similarity metric, such as a correlation coefficient, or may simply be expressed as the expression level difference, or the aggregate of the expression level differences, between a patient sample and a template.

5.3 Markers Useful in Diagnosis and Prognosis of Breast Cancer 5.3.1 Marker Sets The invention provides a set of 4,986 genetic markers whose expression is correlated with the existence of breast cancer by clustering analysis. A subset of these markers identified as useful for diagnosis or prognosis is listed as SEQ ID NOS: 1–2,699. The invention also provides a method of using these markers to distinguish tumor types in diagnosis or prognosis.

In one embodiment, the invention provides a set of 2,460 genetic markers that can classify breast cancer patients by estrogen receptor (ER) status; i.e., distinguish between ER(+) and ER(−) patients or tumors derived from these patients. ER status is an important indicator of the likelihood of a patient's response to some chemotherapies (i.e., tamoxifen). These markers are listed in Table 1. The invention also provides subsets of at least 5, 10, 25, 50, 100, 200, 300, 400, 500, 750, 1,000, 1,250, 1,500, 1,750 or 2,000 genetic markers, drawn from the set of 2,460 markers, which also distinguish ER(+) and ER(−) patients or tumors. Preferably, the number of markers is 550. The invention further provides a set of 550 of the 2,460 markers that are optimal for distinguishing ER status (Table 2). The invention also provides a method of using these markers to distinguish between ER(+) and ER(−) patients or tumors derived therefrom.

In another embodiment, the invention provides a set of 430 genetic markers that can classify ER(−) breast cancer patients by BRCA1 status; i.e., distinguish between tumors containing a BRCA1 mutation and sporadic tumors. These markers are listed in Table 3. The invention further provides subsets of at least 5, 10 20, 30, 40, 50, 75, 100, 150, 200, 250, 300 or 350 markers, drawn from the set of 430 markers, which also distinguish between tumors containing a BRCA1 mutation and sporadic tumors. Preferably, the number of markers is 100. A preferred set of 100 markers is provided in Table 4. The invention also provides a method of using these markers to distinguish between BRCA1 and sporadic patients or tumors derived therefrom.

In another embodiment, the invention provides a set of 231 genetic markers that can distinguish between patients with a good breast cancer prognosis (no breast cancer tumor distant metastases within five years) and patients with a poor breast cancer prognosis (tumor distant metastases within five years). These markers are listed in Table 5. The invention also provides subsets of at least 5, 10, 20, 30, 40, 50, 75, 100, 150 or 200 markers, drawn from the set of 231, which also distinguish between patients with good and poor prognosis. A preferred set of 70 markers is provided in Table 6. In a specific embodiment, the set of markers consists of the twelve kinase-related markers and the seven cell division- or mitosis-related markers listed. The invention also provides a method of using the above markers to distinguish between patients with good or poor prognosis. In another embodiment, the invention provides a method of using the prognosis-associated markers to distinguish between patients having a very good prognosis, an intermediate prognosis, and a poor prognosis, and thereby determining the appropriate combination of adjuvant or hormonal therapy.

TABLE 1

2,460 gene markers that distinguish ER(+) and ER(−) cell samples.

| GenBank Accession Number | SEQ ID NO |
|---|---|
| AA555029_RC | SEQ ID NO 1 |
| AB000509 | SEQ ID NO 2 |
| AB001451 | SEQ ID NO 3 |
| AB002301 | SEQ ID NO 4 |
| AB002308 | SEQ ID NO 5 |
| AB002351 | SEQ ID NO 6 |
| AB002448 | SEQ ID NO 7 |
| AB006628 | SEQ ID NO 9 |
| AB006630 | SEQ ID NO 10 |
| AB006746 | SEQ ID NO 11 |
| AB007458 | SEQ ID NO 12 |
| AB007855 | SEQ ID NO 13 |
| AB007857 | SEQ ID NO 14 |
| AB007863 | SEQ ID NO 15 |
| AB007883 | SEQ ID NO 16 |
| AB007896 | SEQ ID NO 17 |
| AB007899 | SEQ ID NO 18 |
| AB007916 | SEQ ID NO 19 |
| AB007950 | SEQ ID NO 20 |
| AB011087 | SEQ ID NO 21 |
| AB011089 | SEQ ID NO 22 |
| AB011104 | SEQ ID NO 23 |
| AB011105 | SEQ ID NO 24 |
| AB011121 | SEQ ID NO 25 |
| AB011132 | SEQ ID NO 26 |
| AB011152 | SEQ ID NO 27 |
| AB011179 | SEQ ID NO 28 |
| AB014534 | SEQ ID NO 29 |
| AB014568 | SEQ ID NO 30 |
| AB018260 | SEQ ID NO 31 |
| AB018268 | SEQ ID NO 32 |
| AB018289 | SEQ ID NO 33 |
| AB018345 | SEQ ID NO 35 |
| AB020677 | SEQ ID NO 36 |
| AB020689 | SEQ ID NO 37 |
| AB020695 | SEQ ID NO 38 |
| AB020710 | SEQ ID NO 39 |
| AB023139 | SEQ ID NO 40 |
| AB023151 | SEQ ID NO 41 |
| AB023152 | SEQ ID NO 42 |
| AB023163 | SEQ ID NO 43 |
| AB023173 | SEQ ID NO 44 |
| AB023211 | SEQ ID NO 45 |
| AB024704 | SEQ ID NO 46 |
| AB028985 | SEQ ID NO 47 |
| AB028986 | SEQ ID NO 48 |
| AB028998 | SEQ ID NO 49 |
| AB029031 | SEQ ID NO 51 |
| AB032951 | SEQ ID NO 52 |
| AB032966 | SEQ ID NO 53 |
| AB032969 | SEQ ID NO 54 |
| AB032977 | SEQ ID NO 56 |
| AB033007 | SEQ ID NO 58 |
| AB033034 | SEQ ID NO 59 |
| AB033035 | SEQ ID NO 60 |
| AB033040 | SEQ ID NO 61 |
| AB033049 | SEQ ID NO 63 |
| AB033050 | SEQ ID NO 64 |
| AB033053 | SEQ ID NO 65 |
| AB033055 | SEQ ID NO 66 |
| AB033058 | SEQ ID NO 67 |
| AB033073 | SEQ ID NO 68 |
| AB033092 | SEQ ID NO 69 |
| AB033111 | SEQ ID NO 70 |
| AB036063 | SEQ ID NO 71 |
| AB037720 | SEQ ID NO 72 |
| AB037743 | SEQ ID NO 74 |
| AB037745 | SEQ ID NO 75 |
| AB037756 | SEQ ID NO 76 |
| AB037765 | SEQ ID NO 77 |
| AB037778 | SEQ ID NO 78 |
| AB037791 | SEQ ID NO 79 |
| AB037793 | SEQ ID NO 80 |
| AB037802 | SEQ ID NO 81 |
| AB037806 | SEQ ID NO 82 |
| AB037809 | SEQ ID NO 83 |
| AB037836 | SEQ ID NO 84 |
| AB037844 | SEQ ID NO 85 |
| AB037845 | SEQ ID NO 86 |
| AB037848 | SEQ ID NO 87 |
| AB037863 | SEQ ID NO 88 |
| AB037864 | SEQ ID NO 89 |
| AB040881 | SEQ ID NO 90 |
| AB040900 | SEQ ID NO 91 |
| AB040914 | SEQ ID NO 92 |
| AB040926 | SEQ ID NO 93 |
| AB040955 | SEQ ID NO 94 |
| AB040961 | SEQ ID NO 95 |
| AF000974 | SEQ ID NO 97 |
| AF005487 | SEQ ID NO 98 |
| AF007153 | SEQ ID NO 99 |
| AF007155 | SEQ ID NO 100 |
| AF015041 | SEQ ID NO 101 |
| AF016004 | SEQ ID NO 102 |
| AF016495 | SEQ ID NO 103 |
| AF020919 | SEQ ID NO 104 |
| AF026941 | SEQ ID NO 105 |
| AF035191 | SEQ ID NO 106 |
| AF035284 | SEQ ID NO 107 |
| AF035318 | SEQ ID NO 108 |
| AF038182 | SEQ ID NO 109 |
| AF038193 | SEQ ID NO 110 |
| AF042838 | SEQ ID NO 111 |
| AF044127 | SEQ ID NO 112 |
| AF045229 | SEQ ID NO 113 |
| AF047002 | SEQ ID NO 114 |
| AF047826 | SEQ ID NO 115 |
| AF049460 | SEQ ID NO 116 |
| AF052101 | SEQ ID NO 117 |
| AF052117 | SEQ ID NO 118 |
| AF052155 | SEQ ID NO 119 |
| AF052159 | SEQ ID NO 120 |
| AF052176 | SEQ ID NO 122 |
| AF052185 | SEQ ID NO 123 |
| AF055270 | SEQ ID NO 126 |
| AF058075 | SEQ ID NO 127 |
| AF061034 | SEQ ID NO 128 |
| AF063725 | SEQ ID NO 129 |
| AF063936 | SEQ ID NO 130 |
| AF065241 | SEQ ID NO 131 |
| AF067972 | SEQ ID NO 132 |
| AF070536 | SEQ ID NO 133 |
| AF070552 | SEQ ID NO 134 |
| AF070617 | SEQ ID NO 135 |
| AF073770 | SEQ ID NO 138 |
| AF076612 | SEQ ID NO 139 |
| AF079529 | SEQ ID NO 140 |
| AF090913 | SEQ ID NO 142 |
| AF095719 | SEQ ID NO 143 |
| AF098641 | SEQ ID NO 144 |
| AF099032 | SEQ ID NO 145 |
| AF100756 | SEQ ID NO 146 |
| AF101051 | SEQ ID NO 147 |
| AF103375 | SEQ ID NO 148 |
| AF103458 | SEQ ID NO 149 |
| AF103530 | SEQ ID NO 150 |
| AF103804 | SEQ ID NO 151 |
| AF111849 | SEQ ID NO 152 |
| AF112213 | SEQ ID NO 153 |
| AF113132 | SEQ ID NO 154 |
| AF116682 | SEQ ID NO 156 |
| AF118224 | SEQ ID NO 157 |
| AF118274 | SEQ ID NO 158 |
| AF119256 | SEQ ID NO 159 |
| AF119665 | SEQ ID NO 160 |
| AF121255 | SEQ ID NO 161 |

TABLE 1-continued 2,460 gene markers that distinguish ER(+) and ER(−) cell samples.

| GenBank Accession Number | SEQ ID NO |
|---|---|
| AF131748 | SEQ ID NO 162 |
| AF131753 | SEQ ID NO 163 |
| AF131760 | SEQ ID NO 164 |
| AF131784 | SEQ ID NO 165 |
| AF131828 | SEQ ID NO 166 |
| AF135168 | SEQ ID NO 167 |
| AF141882 | SEQ ID NO 168 |
| AF148505 | SEQ ID NO 169 |
| AF149785 | SEQ ID NO 170 |
| AF151810 | SEQ ID NO 171 |
| AF152502 | SEQ ID NO 172 |
| AF155120 | SEQ ID NO 174 |
| AF159092 | SEQ ID NO 175 |
| AF161407 | SEQ ID NO 176 |
| AF161553 | SEQ ID NO 177 |
| AF164104 | SEQ ID NO 178 |
| AF167706 | SEQ ID NO 179 |
| AF175387 | SEQ ID NO 180 |
| AF176012 | SEQ ID NO 181 |
| AF186780 | SEQ ID NO 182 |
| AF217508 | SEQ ID NO 184 |
| AF220492 | SEQ ID NO 185 |
| AF224266 | SEQ ID NO 186 |
| AF230904 | SEQ ID NO 187 |
| AF234532 | SEQ ID NO 188 |
| AF257175 | SEQ ID NO 189 |
| AF257659 | SEQ ID NO 190 |
| AF272357 | SEQ ID NO 191 |
| AF279865 | SEQ ID NO 192 |
| AI497657_RC | SEQ ID NO 193 |
| AJ012755 | SEQ ID NO 194 |
| AJ223353 | SEQ ID NO 195 |
| AJ224741 | SEQ ID NO 196 |
| AJ224864 | SEQ ID NO 197 |
| AJ225092 | SEQ ID NO 198 |
| AJ225093 | SEQ ID NO 199 |
| AJ249377 | SEQ ID NO 200 |
| AJ270996 | SEQ ID NO 202 |
| AJ272057 | SEQ ID NO 203 |
| AJ275978 | SEQ ID NO 204 |
| AJ276429 | SEQ ID NO 205 |
| AK000004 | SEQ ID NO 206 |
| AK000005 | SEQ ID NO 207 |
| AK000106 | SEQ ID NO 208 |
| AK000142 | SEQ ID NO 209 |
| AK000168 | SEQ ID NO 210 |
| AK000345 | SEQ ID NO 212 |
| AK000543 | SEQ ID NO 213 |
| AK000552 | SEQ ID NO 214 |
| AK000643 | SEQ ID NO 216 |
| AK000660 | SEQ ID NO 217 |
| AK000689 | SEQ ID NO 218 |
| AK000770 | SEQ ID NO 220 |
| AK000933 | SEQ ID NO 221 |
| AK001100 | SEQ ID NO 223 |
| AK001164 | SEQ ID NO 224 |
| AK001166 | SEQ ID NO 225 |
| AK001295 | SEQ ID NO 226 |
| AK001380 | SEQ ID NO 227 |
| AK001423 | SEQ ID NO 228 |
| AK001438 | SEQ ID NO 229 |
| AK001492 | SEQ ID NO 230 |
| AK001499 | SEQ ID NO 231 |
| AK001630 | SEQ ID NO 232 |
| AK001872 | SEQ ID NO 234 |
| AK001890 | SEQ ID NO 235 |
| AK002016 | SEQ ID NO 236 |
| AK002088 | SEQ ID NO 237 |
| AK002206 | SEQ ID NO 240 |
| AL035297 | SEQ ID NO 241 |
| AL049265 | SEQ ID NO 242 |
| AL049365 | SEQ ID NO 244 |
| AL049370 | SEQ ID NO 245 |
| AL049381 | SEQ ID NO 246 |
| AL049397 | SEQ ID NO 247 |
| AL049415 | SEQ ID NO 248 |
| AL049667 | SEQ ID NO 249 |
| AL049801 | SEQ ID NO 250 |
| AL049932 | SEQ ID NO 251 |
| AL049935 | SEQ ID NO 252 |
| AL049943 | SEQ ID NO 253 |
| AL049949 | SEQ ID NO 254 |
| AL049963 | SEQ ID NO 255 |
| AL049987 | SEQ ID NO 256 |
| AL050021 | SEQ ID NO 257 |
| AL050024 | SEQ ID NO 258 |
| AL050090 | SEQ ID NO 259 |
| AL050148 | SEQ ID NO 260 |
| AL050151 | SEQ ID NO 261 |
| AL050227 | SEQ ID NO 262 |
| AL050367 | SEQ ID NO 263 |
| AL050370 | SEQ ID NO 264 |
| AL050371 | SEQ ID NO 265 |
| AL050372 | SEQ ID NO 266 |
| AL050388 | SEQ ID NO 267 |
| AL079276 | SEQ ID NO 268 |
| AL079298 | SEQ ID NO 269 |
| AL080079 | SEQ ID NO 271 |
| AL080192 | SEQ ID NO 273 |
| AL080199 | SEQ ID NO 274 |
| AL080209 | SEQ ID NO 275 |
| AL080234 | SEQ ID NO 277 |
| AL080235 | SEQ ID NO 278 |
| AL096737 | SEQ ID NO 279 |
| AL110126 | SEQ ID NO 280 |
| AL110139 | SEQ ID NO 281 |
| AL110202 | SEQ ID NO 283 |
| AL110212 | SEQ ID NO 284 |
| AL110260 | SEQ ID NO 285 |
| AL117441 | SEQ ID NO 286 |
| AL117452 | SEQ ID NO 287 |
| AL117477 | SEQ ID NO 288 |
| AL117502 | SEQ ID NO 289 |
| AL117523 | SEQ ID NO 290 |
| AL117595 | SEQ ID NO 291 |
| AL117599 | SEQ ID NO 292 |
| AL117600 | SEQ ID NO 293 |
| AL117609 | SEQ ID NO 294 |
| AL117617 | SEQ ID NO 295 |
| AL117666 | SEQ ID NO 296 |
| AL122055 | SEQ ID NO 297 |
| AL133033 | SEQ ID NO 298 |
| AL133035 | SEQ ID NO 299 |
| AL133074 | SEQ ID NO 301 |
| AL133096 | SEQ ID NO 302 |
| AL133105 | SEQ ID NO 303 |
| AL133108 | SEQ ID NO 304 |
| AL133572 | SEQ ID NO 305 |
| AL133619 | SEQ ID NO 307 |
| AL133622 | SEQ ID NO 308 |
| AL133623 | SEQ ID NO 309 |
| AL133624 | SEQ ID NO 310 |
| AL133632 | SEQ ID NO 311 |
| AL133644 | SEQ ID NO 312 |
| AL133645 | SEQ ID NO 313 |
| AL133651 | SEQ ID NO 314 |
| AL137310 | SEQ ID NO 316 |
| AL137316 | SEQ ID NO 317 |
| AL137332 | SEQ ID NO 318 |
| AL137342 | SEQ ID NO 319 |
| AL137362 | SEQ ID NO 321 |
| AL137381 | SEQ ID NO 322 |
| AL137407 | SEQ ID NO 323 |
| AL137448 | SEQ ID NO 324 |
| AL137502 | SEQ ID NO 326 |
| AL137514 | SEQ ID NO 327 |

TABLE 1-continued 2,460 gene markers that distinguish ER(+) and ER(−) cell samples.

| GenBank Accession Number | SEQ ID NO |
|---|---|
| AL137540 | SEQ ID NO 328 |
| AL137566 | SEQ ID NO 330 |
| AL137615 | SEQ ID NO 331 |
| AL137673 | SEQ ID NO 335 |
| AL137718 | SEQ ID NO 336 |
| AL137736 | SEQ ID NO 337 |
| AL137751 | SEQ ID NO 338 |
| AL137761 | SEQ ID NO 339 |
| AL157431 | SEQ ID NO 340 |
| AL157432 | SEQ ID NO 341 |
| AL157454 | SEQ ID NO 342 |
| AL157476 | SEQ ID NO 343 |
| AL157480 | SEQ ID NO 344 |
| AL157482 | SEQ ID NO 345 |
| AL157484 | SEQ ID NO 346 |
| AL157492 | SEQ ID NO 347 |
| AL157505 | SEQ ID NO 348 |
| AL157851 | SEQ ID NO 349 |
| AL160131 | SEQ ID NO 350 |
| AL161960 | SEQ ID NO 351 |
| AL162049 | SEQ ID NO 352 |
| AL355708 | SEQ ID NO 353 |
| D13643 | SEQ ID NO 355 |
| D14678 | SEQ ID NO 356 |
| D25328 | SEQ ID NO 357 |
| D26070 | SEQ ID NO 358 |
| D26488 | SEQ ID NO 359 |
| D31887 | SEQ ID NO 360 |
| D38521 | SEQ ID NO 361 |
| D38553 | SEQ ID NO 362 |
| D42043 | SEQ ID NO 363 |
| D42047 | SEQ ID NO 364 |
| D43950 | SEQ ID NO 365 |
| D50402 | SEQ ID NO 366 |
| D50914 | SEQ ID NO 367 |
| D55716 | SEQ ID NO 368 |
| D80001 | SEQ ID NO 369 |
| D80010 | SEQ ID NO 370 |
| D82345 | SEQ ID NO 371 |
| D83781 | SEQ ID NO 372 |
| D86964 | SEQ ID NO 373 |
| D86978 | SEQ ID NO 374 |
| D86985 | SEQ ID NO 375 |
| D87076 | SEQ ID NO 376 |
| D87453 | SEQ ID NO 377 |
| D87469 | SEQ ID NO 378 |
| D87682 | SEQ ID NO 379 |
| G26403 | SEQ ID NO 380 |
| J02639 | SEQ ID NO 381 |
| J04162 | SEQ ID NO 382 |
| K02403 | SEQ ID NO 384 |
| L05096 | SEQ ID NO 385 |
| L10333 | SEQ ID NO 386 |
| L11645 | SEQ ID NO 387 |
| L21934 | SEQ ID NO 388 |
| L22005 | SEQ ID NO 389 |
| L48692 | SEQ ID NO 391 |
| M12758 | SEQ ID NO 392 |
| M15178 | SEQ ID NO 393 |
| M21551 | SEQ ID NO 394 |
| M24895 | SEQ ID NO 395 |
| M26383 | SEQ ID NO 396 |
| M27749 | SEQ ID NO 397 |
| M28170 | SEQ ID NO 398 |
| M29873 | SEQ ID NO 399 |
| M29874 | SEQ ID NO 400 |
| M30448 | SEQ ID NO 401 |
| M30818 | SEQ ID NO 402 |
| M31932 | SEQ ID NO 403 |
| M37033 | SEQ ID NO 404 |
| M55914 | SEQ ID NO 405 |
| M63438 | SEQ ID NO 406 |
| M65254 | SEQ ID NO 407 |
| M68874 | SEQ ID NO 408 |
| M73547 | SEQ ID NO 409 |
| M77142 | SEQ ID NO 410 |
| M80899 | SEQ ID NO 411 |
| M83822 | SEQ ID NO 412 |
| M90657 | SEQ ID NO 413 |
| M93718 | SEQ ID NO 414 |
| M96577 | SEQ ID NO 415 |
| NM_000022 | SEQ ID NO 417 |
| NM_000044 | SEQ ID NO 418 |
| NM_000050 | SEQ ID NO 419 |
| NM_000057 | SEQ ID NO 420 |
| NM_000060 | SEQ ID NO 421 |
| NM_000064 | SEQ ID NO 422 |
| NM_000073 | SEQ ID NO 424 |
| NM_000077 | SEQ ID NO 425 |
| NM_000086 | SEQ ID NO 426 |
| NM_000087 | SEQ ID NO 427 |
| NM_000095 | SEQ ID NO 429 |
| NM_000096 | SEQ ID NO 430 |
| NM_000100 | SEQ ID NO 431 |
| NM_000101 | SEQ ID NO 432 |
| NM_000104 | SEQ ID NO 433 |
| NM_000109 | SEQ ID NO 434 |
| NM_000125 | SEQ ID NO 435 |
| NM_000127 | SEQ ID NO 436 |
| NM_000135 | SEQ ID NO 437 |
| NM_000137 | SEQ ID NO 438 |
| NM_000146 | SEQ ID NO 439 |
| NM_000149 | SEQ ID NO 440 |
| NM_000154 | SEQ ID NO 441 |
| NM_000161 | SEQ ID NO 443 |
| NM_000165 | SEQ ID NO 444 |
| NM_000168 | SEQ ID NO 445 |
| NM_000169 | SEQ ID NO 446 |
| NM_000175 | SEQ ID NO 447 |
| NM_000191 | SEQ ID NO 448 |
| NM_000201 | SEQ ID NO 450 |
| NM_000211 | SEQ ID NO 451 |
| NM_000213 | SEQ ID NO 452 |
| NM_000224 | SEQ ID NO 453 |
| NM_000239 | SEQ ID NO 454 |
| NM_000251 | SEQ ID NO 455 |
| NM_000268 | SEQ ID NO 456 |
| NM_000270 | SEQ ID NO 458 |
| NM_000271 | SEQ ID NO 459 |
| NM_000283 | SEQ ID NO 460 |
| NM_000284 | SEQ ID NO 461 |
| NM_000286 | SEQ ID NO 462 |
| NM_000291 | SEQ ID NO 463 |
| NM_000299 | SEQ ID NO 464 |
| NM_000300 | SEQ ID NO 465 |
| NM_000310 | SEQ ID NO 466 |
| NM_000311 | SEQ ID NO 467 |
| NM_000317 | SEQ ID NO 468 |
| NM_000320 | SEQ ID NO 469 |
| NM_000342 | SEQ ID NO 470 |
| NM_000346 | SEQ ID NO 471 |
| NM_000352 | SEQ ID NO 472 |
| NM_000355 | SEQ ID NO 473 |
| NM_000358 | SEQ ID NO 474 |
| NM_000359 | SEQ ID NO 475 |
| NM_000362 | SEQ ID NO 476 |
| NM_000365 | SEQ ID NO 477 |
| NM_000381 | SEQ ID NO 478 |
| NM_000397 | SEQ ID NO 480 |
| NM_000399 | SEQ ID NO 481 |
| NM_000414 | SEQ ID NO 482 |
| NM_000416 | SEQ ID NO 483 |
| NM_000422 | SEQ ID NO 484 |
| NM_000424 | SEQ ID NO 485 |
| NM_000433 | SEQ ID NO 486 |
| NM_000436 | SEQ ID NO 487 |

TABLE 1-continued 2,460 gene markers that distinguish ER(+) and ER(−) cell samples.

| GenBank Accession Number | SEQ ID NO |
|---|---|
| NM_000450 | SEQ ID NO 488 |
| NM_000462 | SEQ ID NO 489 |
| NM_000495 | SEQ ID NO 490 |
| NM_000507 | SEQ ID NO 491 |
| NM_000526 | SEQ ID NO 492 |
| NM_000557 | SEQ ID NO 493 |
| NM_000560 | SEQ ID NO 494 |
| NM_000576 | SEQ ID NO 495 |
| NM_000579 | SEQ ID NO 496 |
| NM_000584 | SEQ ID NO 497 |
| NM_000591 | SEQ ID NO 498 |
| NM_000592 | SEQ ID NO 499 |
| NM_000593 | SEQ ID NO 500 |
| NM_000594 | SEQ ID NO 501 |
| NM_000597 | SEQ ID NO 502 |
| NM_000600 | SEQ ID NO 504 |
| NM_000607 | SEQ ID NO 505 |
| NM_000612 | SEQ ID NO 506 |
| NM_000627 | SEQ ID NO 507 |
| NM_000633 | SEQ ID NO 508 |
| NM_000636 | SEQ ID NO 509 |
| NM_000639 | SEQ ID NO 510 |
| NM_000647 | SEQ ID NO 511 |
| NM_000655 | SEQ ID NO 512 |
| NM_000662 | SEQ ID NO 513 |
| NM_000663 | SEQ ID NO 514 |
| NM_000666 | SEQ ID NO 515 |
| NM_000676 | SEQ ID NO 516 |
| NM_000685 | SEQ ID NO 517 |
| NM_000693 | SEQ ID NO 518 |
| NM_000699 | SEQ ID NO 519 |
| NM_000700 | SEQ ID NO 520 |
| NM_000712 | SEQ ID NO 521 |
| NM_000727 | SEQ ID NO 522 |
| NM_000732 | SEQ ID NO 523 |
| NM_000734 | SEQ ID NO 524 |
| NM_000767 | SEQ ID NO 525 |
| NM_000784 | SEQ ID NO 526 |
| NM_000802 | SEQ ID NO 528 |
| NM_000824 | SEQ ID NO 529 |
| NM_000849 | SEQ ID NO 530 |
| NM_000852 | SEQ ID NO 531 |
| NM_000874 | SEQ ID NO 532 |
| NM_000878 | SEQ ID NO 533 |
| NM_000884 | SEQ ID NO 534 |
| NM_000908 | SEQ ID NO 537 |
| NM_000909 | SEQ ID NO 538 |
| NM_000926 | SEQ ID NO 539 |
| NM_000930 | SEQ ID NO 540 |
| NM_000931 | SEQ ID NO 541 |
| NM_000947 | SEQ ID NO 542 |
| NM_000949 | SEQ ID NO 543 |
| NM_000950 | SEQ ID NO 544 |
| NM_000954 | SEQ ID NO 545 |
| NM_000964 | SEQ ID NO 546 |
| NM_001003 | SEQ ID NO 549 |
| NM_001016 | SEQ ID NO 551 |
| NM_001047 | SEQ ID NO 553 |
| NM_001066 | SEQ ID NO 555 |
| NM_001071 | SEQ ID NO 556 |
| NM_001078 | SEQ ID NO 557 |
| NM_001085 | SEQ ID NO 558 |
| NM_001089 | SEQ ID NO 559 |
| NM_001109 | SEQ ID NO 560 |
| NM_001122 | SEQ ID NO 561 |
| NM_001124 | SEQ ID NO 562 |
| NM_001161 | SEQ ID NO 563 |
| NM_001165 | SEQ ID NO 564 |
| NM_001166 | SEQ ID NO 565 |
| NM_001168 | SEQ ID NO 566 |
| NM_001179 | SEQ ID NO 567 |
| NM_001185 | SEQ ID NO 569 |
| NM_001203 | SEQ ID NO 570 |
| NM_001207 | SEQ ID NO 573 |
| NM_001216 | SEQ ID NO 574 |
| NM_001218 | SEQ ID NO 575 |
| NM_001223 | SEQ ID NO 576 |
| NM_001225 | SEQ ID NO 577 |
| NM_001233 | SEQ ID NO 578 |
| NM_001236 | SEQ ID NO 579 |
| NM_001237 | SEQ ID NO 580 |
| NM_001251 | SEQ ID NO 581 |
| NM_001255 | SEQ ID NO 582 |
| NM_001262 | SEQ ID NO 583 |
| NM_001263 | SEQ ID NO 584 |
| NM_001267 | SEQ ID NO 585 |
| NM_001276 | SEQ ID NO 587 |
| NM_001280 | SEQ ID NO 588 |
| NM_001282 | SEQ ID NO 589 |
| NM_001295 | SEQ ID NO 590 |
| NM_001305 | SEQ ID NO 591 |
| NM_001310 | SEQ ID NO 592 |
| NM_001312 | SEQ ID NO 593 |
| NM_001321 | SEQ ID NO 594 |
| NM_001327 | SEQ ID NO 595 |
| NM_001329 | SEQ ID NO 596 |
| NM_001333 | SEQ ID NO 597 |
| NM_001338 | SEQ ID NO 598 |
| NM_001360 | SEQ ID NO 599 |
| NM_001363 | SEQ ID NO 600 |
| NM_001381 | SEQ ID NO 601 |
| NM_001394 | SEQ ID NO 602 |
| NM_001395 | SEQ ID NO 603 |
| NM_001419 | SEQ ID NO 604 |
| NM_001424 | SEQ ID NO 605 |
| NM_001428 | SEQ ID NO 606 |
| NM_001436 | SEQ ID NO 607 |
| NM_001444 | SEQ ID NO 608 |
| NM_001446 | SEQ ID NO 609 |
| NM_001453 | SEQ ID NO 611 |
| NM_001456 | SEQ ID NO 612 |
| NM_001457 | SEQ ID NO 613 |
| NM_001463 | SEQ ID NO 614 |
| NM_001465 | SEQ ID NO 615 |
| NM_001481 | SEQ ID NO 616 |
| NM_001493 | SEQ ID NO 617 |
| NM_001494 | SEQ ID NO 618 |
| NM_001500 | SEQ ID NO 619 |
| NM_001504 | SEQ ID NO 620 |
| NM_001511 | SEQ ID NO 621 |
| NM_001513 | SEQ ID NO 622 |
| NM_001527 | SEQ ID NO 623 |
| NM_001529 | SEQ ID NO 624 |
| NM_001530 | SEQ ID NO 625 |
| NM_001540 | SEQ ID NO 626 |
| NM_001550 | SEQ ID NO 627 |
| NM_001551 | SEQ ID NO 628 |
| NM_001552 | SEQ ID NO 629 |
| NM_001554 | SEQ ID NO 631 |
| NM_001558 | SEQ ID NO 632 |
| NM_001560 | SEQ ID NO 633 |
| NM_001565 | SEQ ID NO 634 |
| NM_001569 | SEQ ID NO 635 |
| NM_001605 | SEQ ID NO 636 |
| NM_001609 | SEQ ID NO 637 |
| NM_001615 | SEQ ID NO 638 |
| NM_001623 | SEQ ID NO 639 |
| NM_001627 | SEQ ID NO 640 |
| NM_001628 | SEQ ID NO 641 |
| NM_001630 | SEQ ID NO 642 |
| NM_001634 | SEQ ID NO 643 |
| NM_001656 | SEQ ID NO 644 |
| NM_001673 | SEQ ID NO 645 |
| NM_001675 | SEQ ID NO 647 |
| NM_001679 | SEQ ID NO 648 |
| NM_001689 | SEQ ID NO 649 |

TABLE 1-continued 2,460 gene markers that distinguish ER(+) and ER(−) cell samples.

| GenBank Accession Number | SEQ ID NO |
|---|---|
| NM_001703 | SEQ ID NO 650 |
| NM_001710 | SEQ ID NO 651 |
| NM_001725 | SEQ ID NO 652 |
| NM_001730 | SEQ ID NO 653 |
| NM_001733 | SEQ ID NO 654 |
| NM_001734 | SEQ ID NO 655 |
| NM_001740 | SEQ ID NO 656 |
| NM_001745 | SEQ ID NO 657 |
| NM_001747 | SEQ ID NO 658 |
| NM_001756 | SEQ ID NO 659 |
| NM_001757 | SEQ ID NO 660 |
| NM_001758 | SEQ ID NO 661 |
| NM_001762 | SEQ ID NO 662 |
| NM_001767 | SEQ ID NO 663 |
| NM_001770 | SEQ ID NO 664 |
| NM_001777 | SEQ ID NO 665 |
| NM_001778 | SEQ ID NO 666 |
| NM_001781 | SEQ ID NO 667 |
| NM_001786 | SEQ ID NO 668 |
| NM_001793 | SEQ ID NO 669 |
| NM_001803 | SEQ ID NO 671 |
| NM_001806 | SEQ ID NO 672 |
| NM_001809 | SEQ ID NO 673 |
| NM_001814 | SEQ ID NO 674 |
| NM_001826 | SEQ ID NO 675 |
| NM_001830 | SEQ ID NO 677 |
| NM_001838 | SEQ ID NO 678 |
| NM_001839 | SEQ ID NO 679 |
| NM_001853 | SEQ ID NO 681 |
| NM_001859 | SEQ ID NO 682 |
| NM_001861 | SEQ ID NO 683 |
| NM_001874 | SEQ ID NO 685 |
| NM_001885 | SEQ ID NO 686 |
| NM_001892 | SEQ ID NO 688 |
| NM_001897 | SEQ ID NO 689 |
| NM_001899 | SEQ ID NO 690 |
| NM_001905 | SEQ ID NO 691 |
| NM_001912 | SEQ ID NO 692 |
| NM_001914 | SEQ ID NO 693 |
| NM_001919 | SEQ ID NO 694 |
| NM_001941 | SEQ ID NO 695 |
| NM_001943 | SEQ ID NO 696 |
| NM_001944 | SEQ ID NO 697 |
| NM_001953 | SEQ ID NO 699 |
| NM_001954 | SEQ ID NO 700 |
| NM_001955 | SEQ ID NO 701 |
| NM_001956 | SEQ ID NO 702 |
| NM_001958 | SEQ ID NO 703 |
| NM_001961 | SEQ ID NO 705 |
| NM_001970 | SEQ ID NO 706 |
| NM_001979 | SEQ ID NO 707 |
| NM_001982 | SEQ ID NO 708 |
| NM_002017 | SEQ ID NO 710 |
| NM_002033 | SEQ ID NO 713 |
| NM_002046 | SEQ ID NO 714 |
| NM_002047 | SEQ ID NO 715 |
| NM_002051 | SEQ ID NO 716 |
| NM_002053 | SEQ ID NO 717 |
| NM_002061 | SEQ ID NO 718 |
| NM_002065 | SEQ ID NO 719 |
| NM_002068 | SEQ ID NO 720 |
| NM_002077 | SEQ ID NO 722 |
| NM_002091 | SEQ ID NO 723 |
| NM_002101 | SEQ ID NO 724 |
| NM_002106 | SEQ ID NO 725 |
| NM_002110 | SEQ ID NO 726 |
| NM_002111 | SEQ ID NO 727 |
| NM_002115 | SEQ ID NO 728 |
| NM_002118 | SEQ ID NO 729 |
| NM_002123 | SEQ ID NO 730 |
| NM_002131 | SEQ ID NO 731 |
| NM_002136 | SEQ ID NO 732 |
| NM_002145 | SEQ ID NO 733 |
| NM_002164 | SEQ ID NO 734 |
| NM_002168 | SEQ ID NO 735 |
| NM_002184 | SEQ ID NO 736 |
| NM_002185 | SEQ ID NO 737 |
| NM_002189 | SEQ ID NO 738 |
| NM_002200 | SEQ ID NO 739 |
| NM_002201 | SEQ ID NO 740 |
| NM_002213 | SEQ ID NO 741 |
| NM_002219 | SEQ ID NO 742 |
| NM_002222 | SEQ ID NO 743 |
| NM_002239 | SEQ ID NO 744 |
| NM_002243 | SEQ ID NO 745 |
| NM_002245 | SEQ ID NO 746 |
| NM_002250 | SEQ ID NO 747 |
| NM_002254 | SEQ ID NO 748 |
| NM_002266 | SEQ ID NO 749 |
| NM_002273 | SEQ ID NO 750 |
| NM_002281 | SEQ ID NO 751 |
| NM_002292 | SEQ ID NO 752 |
| NM_002298 | SEQ ID NO 753 |
| NM_002300 | SEQ ID NO 754 |
| NM_002308 | SEQ ID NO 755 |
| NM_002314 | SEQ ID NO 756 |
| NM_002337 | SEQ ID NO 757 |
| NM_002341 | SEQ ID NO 758 |
| NM_002342 | SEQ ID NO 759 |
| NM_002346 | SEQ ID NO 760 |
| NM_002349 | SEQ ID NO 761 |
| NM_002350 | SEQ ID NO 762 |
| NM_002356 | SEQ ID NO 763 |
| NM_002358 | SEQ ID NO 764 |
| NM_002370 | SEQ ID NO 765 |
| NM_002395 | SEQ ID NO 766 |
| NM_002416 | SEQ ID NO 767 |
| NM_002421 | SEQ ID NO 768 |
| NM_002426 | SEQ ID NO 769 |
| NM_002435 | SEQ ID NO 770 |
| NM_002438 | SEQ ID NO 771 |
| NM_002444 | SEQ ID NO 772 |
| NM_002449 | SEQ ID NO 773 |
| NM_002450 | SEQ ID NO 774 |
| NM_002456 | SEQ ID NO 775 |
| NM_002466 | SEQ ID NO 776 |
| NM_002482 | SEQ ID NO 777 |
| NM_002497 | SEQ ID NO 778 |
| NM_002510 | SEQ ID NO 779 |
| NM_002515 | SEQ ID NO 781 |
| NM_002524 | SEQ ID NO 782 |
| NM_002539 | SEQ ID NO 783 |
| NM_002555 | SEQ ID NO 785 |
| NM_002570 | SEQ ID NO 787 |
| NM_002579 | SEQ ID NO 788 |
| NM_002587 | SEQ ID NO 789 |
| NM_002590 | SEQ ID NO 790 |
| NM_002600 | SEQ ID NO 791 |
| NM_002614 | SEQ ID NO 792 |
| NM_002618 | SEQ ID NO 794 |
| NM_002626 | SEQ ID NO 795 |
| NM_002633 | SEQ ID NO 796 |
| NM_002639 | SEQ ID NO 797 |
| NM_002648 | SEQ ID NO 798 |
| NM_002659 | SEQ ID NO 799 |
| NM_002661 | SEQ ID NO 800 |
| NM_002662 | SEQ ID NO 801 |
| NM_002664 | SEQ ID NO 802 |
| NM_002689 | SEQ ID NO 804 |
| NM_002690 | SEQ ID NO 805 |
| NM_002709 | SEQ ID NO 806 |
| NM_002727 | SEQ ID NO 807 |
| NM_002729 | SEQ ID NO 808 |
| NM_002734 | SEQ ID NO 809 |
| NM_002736 | SEQ ID NO 810 |
| NM_002740 | SEQ ID NO 811 |

TABLE 1-continued 2,460 gene markers that distinguish ER(+) and ER(−) cell samples.

| GenBank Accession Number | SEQ ID NO |
|---|---|
| NM_002748 | SEQ ID NO 813 |
| NM_002774 | SEQ ID NO 814 |
| NM_002775 | SEQ ID NO 815 |
| NM_002776 | SEQ ID NO 816 |
| NM_002789 | SEQ ID NO 817 |
| NM_002794 | SEQ ID NO 818 |
| NM_002796 | SEQ ID NO 819 |
| NM_002800 | SEQ ID NO 820 |
| NM_002801 | SEQ ID NO 821 |
| NM_002808 | SEQ ID NO 822 |
| NM_002821 | SEQ ID NO 824 |
| NM_002826 | SEQ ID NO 825 |
| NM_002827 | SEQ ID NO 826 |
| NM_002838 | SEQ ID NO 827 |
| NM_002852 | SEQ ID NO 828 |
| NM_002854 | SEQ ID NO 829 |
| NM_002856 | SEQ ID NO 830 |
| NM_002857 | SEQ ID NO 831 |
| NM_002858 | SEQ ID NO 832 |
| NM_002888 | SEQ ID NO 833 |
| NM_002890 | SEQ ID NO 834 |
| NM_002901 | SEQ ID NO 836 |
| NM_002906 | SEQ ID NO 837 |
| NM_002916 | SEQ ID NO 838 |
| NM_002923 | SEQ ID NO 839 |
| NM_002933 | SEQ ID NO 840 |
| NM_002936 | SEQ ID NO 841 |
| NM_002937 | SEQ ID NO 842 |
| NM_002950 | SEQ ID NO 843 |
| NM_002961 | SEQ ID NO 844 |
| NM_002964 | SEQ ID NO 845 |
| NM_002965 | SEQ ID NO 846 |
| NM_002966 | SEQ ID NO 847 |
| NM_002982 | SEQ ID NO 849 |
| NM_002983 | SEQ ID NO 850 |
| NM_002984 | SEQ ID NO 851 |
| NM_002985 | SEQ ID NO 852 |
| NM_002988 | SEQ ID NO 853 |
| NM_002996 | SEQ ID NO 854 |
| NM_002997 | SEQ ID NO 855 |
| NM_002999 | SEQ ID NO 856 |
| NM_003012 | SEQ ID NO 857 |
| NM_003022 | SEQ ID NO 858 |
| NM_003034 | SEQ ID NO 859 |
| NM_003035 | SEQ ID NO 860 |
| NM_003039 | SEQ ID NO 861 |
| NM_003051 | SEQ ID NO 862 |
| NM_003064 | SEQ ID NO 863 |
| NM_003066 | SEQ ID NO 864 |
| NM_003088 | SEQ ID NO 865 |
| NM_003090 | SEQ ID NO 866 |
| NM_003096 | SEQ ID NO 867 |
| NM_003099 | SEQ ID NO 868 |
| NM_003102 | SEQ ID NO 869 |
| NM_003104 | SEQ ID NO 870 |
| NM_003108 | SEQ ID NO 871 |
| NM_003121 | SEQ ID NO 873 |
| NM_003134 | SEQ ID NO 874 |
| NM_003137 | SEQ ID NO 875 |
| NM_003144 | SEQ ID NO 876 |
| NM_003146 | SEQ ID NO 877 |
| NM_003149 | SEQ ID NO 878 |
| NM_003151 | SEQ ID NO 879 |
| NM_003157 | SEQ ID NO 880 |
| NM_003158 | SEQ ID NO 881 |
| NM_003165 | SEQ ID NO 882 |
| NM_003172 | SEQ ID NO 883 |
| NM_003177 | SEQ ID NO 884 |
| NM_003197 | SEQ ID NO 885 |
| NM_003202 | SEQ ID NO 886 |
| NM_003213 | SEQ ID NO 887 |
| NM_003217 | SEQ ID NO 888 |
| NM_003225 | SEQ ID NO 889 |
| NM_003226 | SEQ ID NO 890 |
| NM_003236 | SEQ ID NO 892 |
| NM_003239 | SEQ ID NO 893 |
| NM_003248 | SEQ ID NO 894 |
| NM_003255 | SEQ ID NO 895 |
| NM_003258 | SEQ ID NO 896 |
| NM_003264 | SEQ ID NO 897 |
| NM_003283 | SEQ ID NO 898 |
| NM_003318 | SEQ ID NO 899 |
| NM_003329 | SEQ ID NO 900 |
| NM_003332 | SEQ ID NO 901 |
| NM_003358 | SEQ ID NO 902 |
| NM_003359 | SEQ ID NO 903 |
| NM_003360 | SEQ ID NO 904 |
| NM_003368 | SEQ ID NO 905 |
| NM_003376 | SEQ ID NO 906 |
| NM_003380 | SEQ ID NO 907 |
| NM_003392 | SEQ ID NO 908 |
| NM_003412 | SEQ ID NO 909 |
| NM_003430 | SEQ ID NO 910 |
| NM_003462 | SEQ ID NO 911 |
| NM_003467 | SEQ ID NO 912 |
| NM_003472 | SEQ ID NO 913 |
| NM_003479 | SEQ ID NO 914 |
| NM_003489 | SEQ ID NO 915 |
| NM_003494 | SEQ ID NO 916 |
| NM_003498 | SEQ ID NO 917 |
| NM_003504 | SEQ ID NO 919 |
| NM_003508 | SEQ ID NO 920 |
| NM_003510 | SEQ ID NO 921 |
| NM_003512 | SEQ ID NO 922 |
| NM_003528 | SEQ ID NO 923 |
| NM_003544 | SEQ ID NO 924 |
| NM_003561 | SEQ ID NO 925 |
| NM_003563 | SEQ ID NO 926 |
| NM_003568 | SEQ ID NO 927 |
| NM_003579 | SEQ ID NO 928 |
| NM_003600 | SEQ ID NO 929 |
| NM_003615 | SEQ ID NO 931 |
| NM_003627 | SEQ ID NO 932 |
| NM_003645 | SEQ ID NO 935 |
| NM_003651 | SEQ ID NO 936 |
| NM_003657 | SEQ ID NO 937 |
| NM_003662 | SEQ ID NO 938 |
| NM_003670 | SEQ ID NO 939 |
| NM_003675 | SEQ ID NO 940 |
| NM_003676 | SEQ ID NO 941 |
| NM_003681 | SEQ ID NO 942 |
| NM_003683 | SEQ ID NO 943 |
| NM_003686 | SEQ ID NO 944 |
| NM_003689 | SEQ ID NO 945 |
| NM_003714 | SEQ ID NO 946 |
| NM_003720 | SEQ ID NO 947 |
| NM_003726 | SEQ ID NO 948 |
| NM_003729 | SEQ ID NO 949 |
| NM_003740 | SEQ ID NO 950 |
| NM_003772 | SEQ ID NO 952 |
| NM_003791 | SEQ ID NO 953 |
| NM_003793 | SEQ ID NO 954 |
| NM_003795 | SEQ ID NO 955 |
| NM_003806 | SEQ ID NO 956 |
| NM_003821 | SEQ ID NO 957 |
| NM_003829 | SEQ ID NO 958 |
| NM_003831 | SEQ ID NO 959 |
| NM_003862 | SEQ ID NO 960 |
| NM_003866 | SEQ ID NO 961 |
| NM_003875 | SEQ ID NO 962 |
| NM_003878 | SEQ ID NO 963 |
| NM_003894 | SEQ ID NO 965 |
| NM_003897 | SEQ ID NO 966 |
| NM_003904 | SEQ ID NO 967 |
| NM_003929 | SEQ ID NO 968 |
| NM_003933 | SEQ ID NO 969 |

TABLE 1-continued 2,460 gene markers that distinguish ER(+) and ER(−) cell samples.

| GenBank Accession Number | SEQ ID NO |
|---|---|
| NM_003937 | SEQ ID NO 970 |
| NM_003940 | SEQ ID NO 971 |
| NM_003942 | SEQ ID NO 972 |
| NM_003944 | SEQ ID NO 973 |
| NM_003953 | SEQ ID NO 974 |
| NM_003954 | SEQ ID NO 975 |
| NM_003975 | SEQ ID NO 976 |
| NM_003981 | SEQ ID NO 977 |
| NM_003982 | SEQ ID NO 978 |
| NM_003986 | SEQ ID NO 979 |
| NM_004003 | SEQ ID NO 980 |
| NM_004010 | SEQ ID NO 981 |
| NM_004024 | SEQ ID NO 982 |
| NM_004038 | SEQ ID NO 983 |
| NM_004049 | SEQ ID NO 984 |
| NM_004052 | SEQ ID NO 985 |
| NM_004053 | SEQ ID NO 986 |
| NM_004079 | SEQ ID NO 987 |
| NM_004104 | SEQ ID NO 988 |
| NM_004109 | SEQ ID NO 989 |
| NM_004110 | SEQ ID NO 990 |
| NM_004120 | SEQ ID NO 991 |
| NM_004131 | SEQ ID NO 992 |
| NM_004143 | SEQ ID NO 993 |
| NM_004154 | SEQ ID NO 994 |
| NM_004170 | SEQ ID NO 996 |
| NM_004172 | SEQ ID NO 997 |
| NM_004176 | SEQ ID NO 998 |
| NM_004180 | SEQ ID NO 999 |
| NM_004181 | SEQ ID NO 1000 |
| NM_004184 | SEQ ID NO 1001 |
| NM_004203 | SEQ ID NO 1002 |
| NM_004207 | SEQ ID NO 1003 |
| NM_004217 | SEQ ID NO 1004 |
| NM_004219 | SEQ ID NO 1005 |
| NM_004221 | SEQ ID NO 1006 |
| NM_004233 | SEQ ID NO 1007 |
| NM_004244 | SEQ ID NO 1008 |
| NM_004252 | SEQ ID NO 1009 |
| NM_004265 | SEQ ID NO 1010 |
| NM_004267 | SEQ ID NO 1011 |
| NM_004281 | SEQ ID NO 1012 |
| NM_004289 | SEQ ID NO 1013 |
| NM_004298 | SEQ ID NO 1015 |
| NM_004301 | SEQ ID NO 1016 |
| NM_004305 | SEQ ID NO 1017 |
| NM_004311 | SEQ ID NO 1018 |
| NM_004315 | SEQ ID NO 1019 |
| NM_004323 | SEQ ID NO 1020 |
| NM_004330 | SEQ ID NO 1021 |
| NM_004336 | SEQ ID NO 1022 |
| NM_004338 | SEQ ID NO 1023 |
| NM_004350 | SEQ ID NO 1024 |
| NM_004354 | SEQ ID NO 1025 |
| NM_004358 | SEQ ID NO 1026 |
| NM_004360 | SEQ ID NO 1027 |
| NM_004362 | SEQ ID NO 1028 |
| NM_004374 | SEQ ID NO 1029 |
| NM_004378 | SEQ ID NO 1030 |
| NM_004392 | SEQ ID NO 1031 |
| NM_004395 | SEQ ID NO 1032 |
| NM_004414 | SEQ ID NO 1033 |
| NM_004418 | SEQ ID NO 1034 |
| NM_004425 | SEQ ID NO 1035 |
| NM_004431 | SEQ ID NO 1036 |
| NM_004436 | SEQ ID NO 1037 |
| NM_004438 | SEQ ID NO 1038 |
| NM_004443 | SEQ ID NO 1039 |
| NM_004446 | SEQ ID NO 1040 |
| NM_004451 | SEQ ID NO 1041 |
| NM_004454 | SEQ ID NO 1042 |
| NM_004456 | SEQ ID NO 1043 |
| NM_004458 | SEQ ID NO 1044 |
| NM_004472 | SEQ ID NO 1045 |
| NM_004480 | SEQ ID NO 1046 |
| NM_004482 | SEQ ID NO 1047 |
| NM_004494 | SEQ ID NO 1048 |
| NM_004496 | SEQ ID NO 1049 |
| NM_004503 | SEQ ID NO 1050 |
| NM_004504 | SEQ ID NO 1051 |
| NM_004515 | SEQ ID NO 1052 |
| NM_004522 | SEQ ID NO 1053 |
| NM_004523 | SEQ ID NO 1054 |
| NM_004525 | SEQ ID NO 1055 |
| NM_004556 | SEQ ID NO 1056 |
| NM_004559 | SEQ ID NO 1057 |
| NM_004569 | SEQ ID NO 1058 |
| NM_004577 | SEQ ID NO 1059 |
| NM_004585 | SEQ ID NO 1060 |
| NM_004587 | SEQ ID NO 1061 |
| NM_004594 | SEQ ID NO 1062 |
| NM_004599 | SEQ ID NO 1063 |
| NM_004633 | SEQ ID NO 1066 |
| NM_004642 | SEQ ID NO 1067 |
| NM_004648 | SEQ ID NO 1068 |
| NM_004663 | SEQ ID NO 1069 |
| NM_004664 | SEQ ID NO 1070 |
| NM_004684 | SEQ ID NO 1071 |
| NM_004688 | SEQ ID NO 1072 |
| NM_004694 | SEQ ID NO 1073 |
| NM_004695 | SEQ ID NO 1074 |
| NM_004701 | SEQ ID NO 1075 |
| NM_004708 | SEQ ID NO 1077 |
| NM_004711 | SEQ ID NO 1078 |
| NM_004726 | SEQ ID NO 1079 |
| NM_004750 | SEQ ID NO 1081 |
| NM_004761 | SEQ ID NO 1082 |
| NM_004762 | SEQ ID NO 1083 |
| NM_004780 | SEQ ID NO 1085 |
| NM_004791 | SEQ ID NO 1086 |
| NM_004798 | SEQ ID NO 1087 |
| NM_004808 | SEQ ID NO 1088 |
| NM_004811 | SEQ ID NO 1089 |
| NM_004833 | SEQ ID NO 1090 |
| NM_004835 | SEQ ID NO 1091 |
| NM_004843 | SEQ ID NO 1092 |
| NM_004847 | SEQ ID NO 1093 |
| NM_004848 | SEQ ID NO 1094 |
| NM_004864 | SEQ ID NO 1095 |
| NM_004865 | SEQ ID NO 1096 |
| NM_004866 | SEQ ID NO 1097 |
| NM_004877 | SEQ ID NO 1098 |
| NM_004900 | SEQ ID NO 1099 |
| NM_004906 | SEQ ID NO 1100 |
| NM_004910 | SEQ ID NO 1101 |
| NM_004918 | SEQ ID NO 1103 |
| NM_004923 | SEQ ID NO 1104 |
| NM_004938 | SEQ ID NO 1105 |
| NM_004951 | SEQ ID NO 1106 |
| NM_004968 | SEQ ID NO 1107 |
| NM_004994 | SEQ ID NO 1108 |
| NM_004999 | SEQ ID NO 1109 |
| NM_005001 | SEQ ID NO 1110 |
| NM_005002 | SEQ ID NO 1111 |
| NM_005012 | SEQ ID NO 1112 |
| NM_005032 | SEQ ID NO 1113 |
| NM_005044 | SEQ ID NO 1114 |
| NM_005046 | SEQ ID NO 1115 |
| NM_005049 | SEQ ID NO 1116 |
| NM_005067 | SEQ ID NO 1117 |
| NM_005077 | SEQ ID NO 1118 |
| NM_005080 | SEQ ID NO 1119 |
| NM_005084 | SEQ ID NO 1120 |
| NM_005130 | SEQ ID NO 1122 |
| NM_005139 | SEQ ID NO 1123 |
| NM_005168 | SEQ ID NO 1125 |

TABLE 1-continued

2,460 gene markers that distinguish ER(+) and ER(−) cell samples.

| GenBank Accession Number | SEQ ID NO |
|---|---|
| NM_005190 | SEQ ID NO 1126 |
| NM_005196 | SEQ ID NO 1127 |
| NM_005213 | SEQ ID NO 1128 |
| NM_005218 | SEQ ID NO 1129 |
| NM_005235 | SEQ ID NO 1130 |
| NM_005245 | SEQ ID NO 1131 |
| NM_005249 | SEQ ID NO 1132 |
| NM_005257 | SEQ ID NO 1133 |
| NM_005264 | SEQ ID NO 1134 |
| NM_005271 | SEQ ID NO 1135 |
| NM_005314 | SEQ ID NO 1136 |
| NM_005321 | SEQ ID NO 1137 |
| NM_005322 | SEQ ID NO 1138 |
| NM_005325 | SEQ ID NO 1139 |
| NM_005326 | SEQ ID NO 1140 |
| NM_005335 | SEQ ID NO 1141 |
| NM_005337 | SEQ ID NO 1142 |
| NM_005342 | SEQ ID NO 1143 |
| NM_005345 | SEQ ID NO 1144 |
| NM_005357 | SEQ ID NO 1145 |
| NM_005375 | SEQ ID NO 1146 |
| NM_005391 | SEQ ID NO 1147 |
| NM_005408 | SEQ ID NO 1148 |
| NM_005409 | SEQ ID NO 1149 |
| NM_005410 | SEQ ID NO 1150 |
| NM_005426 | SEQ ID NO 1151 |
| NM_005433 | SEQ ID NO 1152 |
| NM_005441 | SEQ ID NO 1153 |
| NM_005443 | SEQ ID NO 1154 |
| NM_005483 | SEQ ID NO 1155 |
| NM_005486 | SEQ ID NO 1156 |
| NM_005496 | SEQ ID NO 1157 |
| NM_005498 | SEQ ID NO 1158 |
| NM_005499 | SEQ ID NO 1159 |
| NM_005514 | SEQ ID NO 1160 |
| NM_005531 | SEQ ID NO 1162 |
| NM_005538 | SEQ ID NO 1163 |
| NM_005541 | SEQ ID NO 1164 |
| NM_005544 | SEQ ID NO 1165 |
| NM_005548 | SEQ ID NO 1166 |
| NM_005554 | SEQ ID NO 1167 |
| NM_005555 | SEQ ID NO 1168 |
| NM_005556 | SEQ ID NO 1169 |
| NM_005557 | SEQ ID NO 1170 |
| NM_005558 | SEQ ID NO 1171 |
| NM_005562 | SEQ ID NO 1172 |
| NM_005563 | SEQ ID NO 1173 |
| NM_005565 | SEQ ID NO 1174 |
| NM_005566 | SEQ ID NO 1175 |
| NM_005572 | SEQ ID NO 1176 |
| NM_005582 | SEQ ID NO 1177 |
| NM_005608 | SEQ ID NO 1178 |
| NM_005614 | SEQ ID NO 1179 |
| NM_005617 | SEQ ID NO 1180 |
| NM_005620 | SEQ ID NO 1181 |
| NM_005625 | SEQ ID NO 1182 |
| NM_005651 | SEQ ID NO 1183 |
| NM_005658 | SEQ ID NO 1184 |
| NM_005659 | SEQ ID NO 1185 |
| NM_005667 | SEQ ID NO 1186 |
| NM_005686 | SEQ ID NO 1187 |
| NM_005690 | SEQ ID NO 1188 |
| NM_005720 | SEQ ID NO 1190 |
| NM_005727 | SEQ ID NO 1191 |
| NM_005733 | SEQ ID NO 1192 |
| NM_005737 | SEQ ID NO 1193 |
| NM_005742 | SEQ ID NO 1194 |
| NM_005746 | SEQ ID NO 1195 |
| NM_005749 | SEQ ID NO 1196 |
| NM_005760 | SEQ ID NO 1197 |
| NM_005764 | SEQ ID NO 1198 |
| NM_005794 | SEQ ID NO 1199 |
| NM_005796 | SEQ ID NO 1200 |
| NM_005804 | SEQ ID NO 1201 |
| NM_005813 | SEQ ID NO 1202 |
| NM_005824 | SEQ ID NO 1203 |
| NM_005825 | SEQ ID NO 1204 |
| NM_005849 | SEQ ID NO 1205 |
| NM_005853 | SEQ ID NO 1206 |
| NM_005855 | SEQ ID NO 1207 |
| NM_005864 | SEQ ID NO 1208 |
| NM_005874 | SEQ ID NO 1209 |
| NM_005876 | SEQ ID NO 1210 |
| NM_005880 | SEQ ID NO 1211 |
| NM_005891 | SEQ ID NO 1212 |
| NM_005892 | SEQ ID NO 1213 |
| NM_005899 | SEQ ID NO 1214 |
| NM_005915 | SEQ ID NO 1215 |
| NM_005919 | SEQ ID NO 1216 |
| NM_005923 | SEQ ID NO 1217 |
| NM_005928 | SEQ ID NO 1218 |
| NM_005932 | SEQ ID NO 1219 |
| NM_005935 | SEQ ID NO 1220 |
| NM_005945 | SEQ ID NO 1221 |
| NM_005953 | SEQ ID NO 1222 |
| NM_005978 | SEQ ID NO 1223 |
| NM_005990 | SEQ ID NO 1224 |
| NM_006002 | SEQ ID NO 1225 |
| NM_006004 | SEQ ID NO 1226 |
| NM_006005 | SEQ ID NO 1227 |
| NM_006006 | SEQ ID NO 1228 |
| NM_006017 | SEQ ID NO 1229 |
| NM_006018 | SEQ ID NO 1230 |
| NM_006023 | SEQ ID NO 1231 |
| NM_006027 | SEQ ID NO 1232 |
| NM_006029 | SEQ ID NO 1233 |
| NM_006033 | SEQ ID NO 1234 |
| NM_006051 | SEQ ID NO 1235 |
| NM_006055 | SEQ ID NO 1236 |
| NM_006074 | SEQ ID NO 1237 |
| NM_006086 | SEQ ID NO 1238 |
| NM_006087 | SEQ ID NO 1239 |
| NM_006096 | SEQ ID NO 1240 |
| NM_006101 | SEQ ID NO 1241 |
| NM_006103 | SEQ ID NO 1242 |
| NM_006111 | SEQ ID NO 1243 |
| NM_006113 | SEQ ID NO 1244 |
| NM_006115 | SEQ ID NO 1245 |
| NM_006117 | SEQ ID NO 1246 |
| NM_006142 | SEQ ID NO 1247 |
| NM_006144 | SEQ ID NO 1248 |
| NM_006148 | SEQ ID NO 1249 |
| NM_006153 | SEQ ID NO 1250 |
| NM_006159 | SEQ ID NO 1251 |
| NM_006170 | SEQ ID NO 1252 |
| NM_006197 | SEQ ID NO 1253 |
| NM_006224 | SEQ ID NO 1255 |
| NM_006227 | SEQ ID NO 1256 |
| NM_006235 | SEQ ID NO 1257 |
| NM_006243 | SEQ ID NO 1258 |
| NM_006264 | SEQ ID NO 1259 |
| NM_006271 | SEQ ID NO 1261 |
| NM_006274 | SEQ ID NO 1262 |
| NM_006290 | SEQ ID NO 1265 |
| NM_006291 | SEQ ID NO 1266 |
| NM_006296 | SEQ ID NO 1267 |
| NM_006304 | SEQ ID NO 1268 |
| NM_006314 | SEQ ID NO 1269 |
| NM_006332 | SEQ ID NO 1270 |
| NM_006357 | SEQ ID NO 1271 |
| NM_006366 | SEQ ID NO 1272 |
| NM_006372 | SEQ ID NO 1273 |
| NM_006377 | SEQ ID NO 1274 |
| NM_006378 | SEQ ID NO 1275 |
| NM_006383 | SEQ ID NO 1276 |
| NM_006389 | SEQ ID NO 1277 |

TABLE 1-continued 2,460 gene markers that distinguish ER(+) and ER(−) cell samples.

| GenBank Accession Number | SEQ ID NO |
|---|---|
| NM_006393 | SEQ ID NO 1278 |
| NM_006398 | SEQ ID NO 1279 |
| NM_006406 | SEQ ID NO 1280 |
| NM_006408 | SEQ ID NO 1281 |
| NM_006410 | SEQ ID NO 1282 |
| NM_006414 | SEQ ID NO 1283 |
| NM_006417 | SEQ ID NO 1284 |
| NM_006430 | SEQ ID NO 1285 |
| NM_006460 | SEQ ID NO 1286 |
| NM_006461 | SEQ ID NO 1287 |
| NM_006469 | SEQ ID NO 1288 |
| NM_006470 | SEQ ID NO 1289 |
| NM_006491 | SEQ ID NO 1290 |
| NM_006495 | SEQ ID NO 1291 |
| NM_006500 | SEQ ID NO 1292 |
| NM_006509 | SEQ ID NO 1293 |
| NM_006516 | SEQ ID NO 1294 |
| NM_006533 | SEQ ID NO 1295 |
| NM_006551 | SEQ ID NO 1296 |
| NM_006556 | SEQ ID NO 1297 |
| NM_006558 | SEQ ID NO 1298 |
| NM_006564 | SEQ ID NO 1299 |
| NM_006573 | SEQ ID NO 1300 |
| NM_006607 | SEQ ID NO 1301 |
| NM_006622 | SEQ ID NO 1302 |
| NM_006623 | SEQ ID NO 1303 |
| NM_006636 | SEQ ID NO 1304 |
| NM_006670 | SEQ ID NO 1305 |
| NM_006681 | SEQ ID NO 1306 |
| NM_006682 | SEQ ID NO 1307 |
| NM_006696 | SEQ ID NO 1308 |
| NM_006698 | SEQ ID NO 1309 |
| NM_006705 | SEQ ID NO 1310 |
| NM_006739 | SEQ ID NO 1311 |
| NM_006748 | SEQ ID NO 1312 |
| NM_006759 | SEQ ID NO 1313 |
| NM_006762 | SEQ ID NO 1314 |
| NM_006763 | SEQ ID NO 1315 |
| NM_006769 | SEQ ID NO 1316 |
| NM_006770 | SEQ ID NO 1317 |
| NM_006780 | SEQ ID NO 1318 |
| NM_006787 | SEQ ID NO 1319 |
| NM_006806 | SEQ ID NO 1320 |
| NM_006813 | SEQ ID NO 1321 |
| NM_006825 | SEQ ID NO 1322 |
| NM_006826 | SEQ ID NO 1323 |
| NM_006829 | SEQ ID NO 1324 |
| NM_006834 | SEQ ID NO 1325 |
| NM_006835 | SEQ ID NO 1326 |
| NM_006840 | SEQ ID NO 1327 |
| NM_006845 | SEQ ID NO 1328 |
| NM_006847 | SEQ ID NO 1329 |
| NM_006851 | SEQ ID NO 1330 |
| NM_006855 | SEQ ID NO 1331 |
| NM_006864 | SEQ ID NO 1332 |
| NM_006868 | SEQ ID NO 1333 |
| NM_006875 | SEQ ID NO 1334 |
| NM_006889 | SEQ ID NO 1336 |
| NM_006892 | SEQ ID NO 1337 |
| NM_006912 | SEQ ID NO 1338 |
| NM_006931 | SEQ ID NO 1341 |
| NM_006941 | SEQ ID NO 1342 |
| NM_006943 | SEQ ID NO 1343 |
| NM_006984 | SEQ ID NO 1344 |
| NM_007005 | SEQ ID NO 1345 |
| NM_007006 | SEQ ID NO 1346 |
| NM_007019 | SEQ ID NO 1347 |
| NM_007027 | SEQ ID NO 1348 |
| NM_007044 | SEQ ID NO 1350 |
| NM_007050 | SEQ ID NO 1351 |
| NM_007057 | SEQ ID NO 1352 |
| NM_007069 | SEQ ID NO 1353 |
| NM_007074 | SEQ ID NO 1355 |
| NM_007088 | SEQ ID NO 1356 |
| NM_007111 | SEQ ID NO 1357 |
| NM_007146 | SEQ ID NO 1358 |
| NM_007173 | SEQ ID NO 1359 |
| NM_007177 | SEQ ID NO 1360 |
| NM_007196 | SEQ ID NO 1361 |
| NM_007203 | SEQ ID NO 1362 |
| NM_007214 | SEQ ID NO 1363 |
| NM_007217 | SEQ ID NO 1364 |
| NM_007231 | SEQ ID NO 1365 |
| NM_007268 | SEQ ID NO 1367 |
| NM_007274 | SEQ ID NO 1368 |
| NM_007275 | SEQ ID NO 1369 |
| NM_007281 | SEQ ID NO 1370 |
| NM_007309 | SEQ ID NO 1371 |
| NM_007315 | SEQ ID NO 1372 |
| NM_007334 | SEQ ID NO 1373 |
| NM_007358 | SEQ ID NO 1374 |
| NM_009585 | SEQ ID NO 1375 |
| NM_009587 | SEQ ID NO 1376 |
| NM_009588 | SEQ ID NO 1377 |
| NM_012062 | SEQ ID NO 1378 |
| NM_012067 | SEQ ID NO 1379 |
| NM_012101 | SEQ ID NO 1380 |
| NM_012105 | SEQ ID NO 1381 |
| NM_012108 | SEQ ID NO 1382 |
| NM_012110 | SEQ ID NO 1383 |
| NM_012124 | SEQ ID NO 1384 |
| NM_012142 | SEQ ID NO 1386 |
| NM_012155 | SEQ ID NO 1388 |
| NM_012175 | SEQ ID NO 1389 |
| NM_012177 | SEQ ID NO 1390 |
| NM_012205 | SEQ ID NO 1391 |
| NM_012219 | SEQ ID NO 1393 |
| NM_012242 | SEQ ID NO 1394 |
| NM_012250 | SEQ ID NO 1395 |
| NM_012261 | SEQ ID NO 1397 |
| NM_012286 | SEQ ID NO 1398 |
| NM_012319 | SEQ ID NO 1400 |
| NM_012332 | SEQ ID NO 1401 |
| NM_012336 | SEQ ID NO 1402 |
| NM_012339 | SEQ ID NO 1404 |
| NM_012341 | SEQ ID NO 1405 |
| NM_012391 | SEQ ID NO 1406 |
| NM_012394 | SEQ ID NO 1407 |
| NM_012413 | SEQ ID NO 1408 |
| NM_012421 | SEQ ID NO 1409 |
| NM_012425 | SEQ ID NO 1410 |
| NM_012427 | SEQ ID NO 1411 |
| NM_012429 | SEQ ID NO 1413 |
| NM_012446 | SEQ ID NO 1414 |
| NM_012463 | SEQ ID NO 1415 |
| NM_012474 | SEQ ID NO 1416 |
| NM_013230 | SEQ ID NO 1417 |
| NM_013233 | SEQ ID NO 1418 |
| NM_013238 | SEQ ID NO 1419 |
| NM_013239 | SEQ ID NO 1420 |
| NM_013242 | SEQ ID NO 1421 |
| NM_013257 | SEQ ID NO 1423 |
| NM_013261 | SEQ ID NO 1424 |
| NM_013262 | SEQ ID NO 1425 |
| NM_013277 | SEQ ID NO 1426 |
| NM_013296 | SEQ ID NO 1427 |
| NM_013301 | SEQ ID NO 1428 |
| NM_013324 | SEQ ID NO 1429 |
| NM_013327 | SEQ ID NO 1430 |
| NM_013336 | SEQ ID NO 1431 |
| NM_013339 | SEQ ID NO 1432 |
| NM_013363 | SEQ ID NO 1433 |
| NM_013378 | SEQ ID NO 1435 |
| NM_013384 | SEQ ID NO 1436 |
| NM_013385 | SEQ ID NO 1437 |
| NM_013406 | SEQ ID NO 1438 |

TABLE 1-continued 2,460 gene markers that distinguish ER(+) and ER(−) cell samples.

| GenBank Accession Number | SEQ ID NO |
|---|---|
| NM_013437 | SEQ ID NO 1439 |
| NM_013451 | SEQ ID NO 1440 |
| NM_013943 | SEQ ID NO 1441 |
| NM_013994 | SEQ ID NO 1442 |
| NM_013995 | SEQ ID NO 1443 |
| NM_014026 | SEQ ID NO 1444 |
| NM_014029 | SEQ ID NO 1445 |
| NM_014036 | SEQ ID NO 1446 |
| NM_014062 | SEQ ID NO 1447 |
| NM_014074 | SEQ ID NO 1448 |
| NM_014096 | SEQ ID NO 1450 |
| NM_014109 | SEQ ID NO 1451 |
| NM_014112 | SEQ ID NO 1452 |
| NM_014147 | SEQ ID NO 1453 |
| NM_014149 | SEQ ID NO 1454 |
| NM_014164 | SEQ ID NO 1455 |
| NM_014172 | SEQ ID NO 1456 |
| NM_014175 | SEQ ID NO 1457 |
| NM_014181 | SEQ ID NO 1458 |
| NM_014184 | SEQ ID NO 1459 |
| NM_014211 | SEQ ID NO 1460 |
| NM_014214 | SEQ ID NO 1461 |
| NM_014216 | SEQ ID NO 1462 |
| NM_014241 | SEQ ID NO 1463 |
| NM_014246 | SEQ ID NO 1465 |
| NM_014268 | SEQ ID NO 1466 |
| NM_014272 | SEQ ID NO 1467 |
| NM_014274 | SEQ ID NO 1468 |
| NM_014289 | SEQ ID NO 1469 |
| NM_014298 | SEQ ID NO 1470 |
| NM_014302 | SEQ ID NO 1471 |
| NM_014315 | SEQ ID NO 1473 |
| NM_014316 | SEQ ID NO 1474 |
| NM_014317 | SEQ ID NO 1475 |
| NM_014320 | SEQ ID NO 1476 |
| NM_014321 | SEQ ID NO 1477 |
| NM_014325 | SEQ ID NO 1478 |
| NM_014335 | SEQ ID NO 1479 |
| NM_014363 | SEQ ID NO 1480 |
| NM_014364 | SEQ ID NO 1481 |
| NM_014365 | SEQ ID NO 1482 |
| NM_014373 | SEQ ID NO 1483 |
| NM_014382 | SEQ ID NO 1484 |
| NM_014395 | SEQ ID NO 1485 |
| NM_014398 | SEQ ID NO 1486 |
| NM_014399 | SEQ ID NO 1487 |
| NM_014402 | SEQ ID NO 1488 |
| NM_014428 | SEQ ID NO 1489 |
| NM_014448 | SEQ ID NO 1490 |
| NM_014449 | SEQ ID NO 1491 |
| NM_014450 | SEQ ID NO 1492 |
| NM_014452 | SEQ ID NO 1493 |
| NM_014453 | SEQ ID NO 1494 |
| NM_014456 | SEQ ID NO 1495 |
| NM_014479 | SEQ ID NO 1497 |
| NM_014501 | SEQ ID NO 1498 |
| NM_014552 | SEQ ID NO 1500 |
| NM_014553 | SEQ ID NO 1501 |
| NM_014570 | SEQ ID NO 1502 |
| NM_014575 | SEQ ID NO 1503 |
| NM_014585 | SEQ ID NO 1504 |
| NM_014595 | SEQ ID NO 1505 |
| NM_014624 | SEQ ID NO 1507 |
| NM_014633 | SEQ ID NO 1508 |
| NM_014640 | SEQ ID NO 1509 |
| NM_014642 | SEQ ID NO 1510 |
| NM_014643 | SEQ ID NO 1511 |
| NM_014656 | SEQ ID NO 1512 |
| NM_014668 | SEQ ID NO 1513 |
| NM_014669 | SEQ ID NO 1514 |
| NM_014673 | SEQ ID NO 1515 |
| NM_014675 | SEQ ID NO 1516 |
| NM_014679 | SEQ ID NO 1517 |
| NM_014680 | SEQ ID NO 1518 |
| NM_014696 | SEQ ID NO 1519 |
| NM_014700 | SEQ ID NO 1520 |
| NM_014715 | SEQ ID NO 1521 |
| NM_014721 | SEQ ID NO 1522 |
| NM_014737 | SEQ ID NO 1524 |
| NM_014738 | SEQ ID NO 1525 |
| NM_014747 | SEQ ID NO 1526 |
| NM_014750 | SEQ ID NO 1527 |
| NM_014754 | SEQ ID NO 1528 |
| NM_014767 | SEQ ID NO 1529 |
| NM_014770 | SEQ ID NO 1530 |
| NM_014773 | SEQ ID NO 1531 |
| NM_014776 | SEQ ID NO 1532 |
| NM_014782 | SEQ ID NO 1533 |
| NM_014785 | SEQ ID NO 1534 |
| NM_014791 | SEQ ID NO 1535 |
| NM_014808 | SEQ ID NO 1536 |
| NM_014811 | SEQ ID NO 1537 |
| NM_014812 | SEQ ID NO 1538 |
| NM_014838 | SEQ ID NO 1540 |
| NM_014862 | SEQ ID NO 1542 |
| NM_014865 | SEQ ID NO 1543 |
| NM_014870 | SEQ ID NO 1544 |
| NM_014875 | SEQ ID NO 1545 |
| NM_014886 | SEQ ID NO 1547 |
| NM_014889 | SEQ ID NO 1548 |
| NM_014905 | SEQ ID NO 1549 |
| NM_014935 | SEQ ID NO 1550 |
| NM_014945 | SEQ ID NO 1551 |
| NM_014965 | SEQ ID NO 1552 |
| NM_014967 | SEQ ID NO 1553 |
| NM_014968 | SEQ ID NO 1554 |
| NM_015032 | SEQ ID NO 1555 |
| NM_015239 | SEQ ID NO 1556 |
| NM_015383 | SEQ ID NO 1557 |
| NM_015392 | SEQ ID NO 1558 |
| NM_015416 | SEQ ID NO 1559 |
| NM_015417 | SEQ ID NO 1560 |
| NM_015420 | SEQ ID NO 1561 |
| NM_015434 | SEQ ID NO 1562 |
| NM_015474 | SEQ ID NO 1563 |
| NM_015507 | SEQ ID NO 1565 |
| NM_015513 | SEQ ID NO 1566 |
| NM_015515 | SEQ ID NO 1567 |
| NM_015523 | SEQ ID NO 1568 |
| NM_015524 | SEQ ID NO 1569 |
| NM_015599 | SEQ ID NO 1571 |
| NM_015623 | SEQ ID NO 1572 |
| NM_015640 | SEQ ID NO 1573 |
| NM_015641 | SEQ ID NO 1574 |
| NM_015678 | SEQ ID NO 1575 |
| NM_015721 | SEQ ID NO 1576 |
| NM_015892 | SEQ ID NO 1578 |
| NM_015895 | SEQ ID NO 1579 |
| NM_015907 | SEQ ID NO 1580 |
| NM_015925 | SEQ ID NO 1581 |
| NM_015937 | SEQ ID NO 1582 |
| NM_015954 | SEQ ID NO 1583 |
| NM_015955 | SEQ ID NO 1584 |
| NM_015961 | SEQ ID NO 1585 |
| NM_015984 | SEQ ID NO 1587 |
| NM_015986 | SEQ ID NO 1588 |
| NM_015987 | SEQ ID NO 1589 |
| NM_015991 | SEQ ID NO 1590 |
| NM_016002 | SEQ ID NO 1592 |
| NM_016028 | SEQ ID NO 1594 |
| NM_016029 | SEQ ID NO 1595 |
| NM_016047 | SEQ ID NO 1596 |
| NM_016048 | SEQ ID NO 1597 |
| NM_016050 | SEQ ID NO 1598 |
| NM_016056 | SEQ ID NO 1599 |
| NM_016058 | SEQ ID NO 1600 |

TABLE 1-continued 2,460 gene markers that distinguish ER(+) and ER(−) cell samples.

| GenBank Accession Number | SEQ ID NO |
|---|---|
| NM_016066 | SEQ ID NO 1601 |
| NM_016072 | SEQ ID NO 1602 |
| NM_016073 | SEQ ID NO 1603 |
| NM_016108 | SEQ ID NO 1605 |
| NM_016109 | SEQ ID NO 1606 |
| NM_016121 | SEQ ID NO 1607 |
| NM_016126 | SEQ ID NO 1608 |
| NM_016127 | SEQ ID NO 1609 |
| NM_016135 | SEQ ID NO 1610 |
| NM_016142 | SEQ ID NO 1612 |
| NM_016153 | SEQ ID NO 1613 |
| NM_016171 | SEQ ID NO 1614 |
| NM_016175 | SEQ ID NO 1615 |
| NM_016184 | SEQ ID NO 1616 |
| NM_016185 | SEQ ID NO 1617 |
| NM_016187 | SEQ ID NO 1618 |
| NM_016199 | SEQ ID NO 1619 |
| NM_016210 | SEQ ID NO 1620 |
| NM_016217 | SEQ ID NO 1621 |
| NM_016228 | SEQ ID NO 1623 |
| NM_016229 | SEQ ID NO 1624 |
| NM_016235 | SEQ ID NO 1625 |
| NM_016240 | SEQ ID NO 1626 |
| NM_016243 | SEQ ID NO 1627 |
| NM_016250 | SEQ ID NO 1628 |
| NM_016267 | SEQ ID NO 1629 |
| NM_016271 | SEQ ID NO 1630 |
| NM_016299 | SEQ ID NO 1631 |
| NM_016306 | SEQ ID NO 1632 |
| NM_016308 | SEQ ID NO 1634 |
| NM_016321 | SEQ ID NO 1635 |
| NM_016337 | SEQ ID NO 1636 |
| NM_016352 | SEQ ID NO 1637 |
| NM_016359 | SEQ ID NO 1638 |
| NM_016401 | SEQ ID NO 1641 |
| NM_016403 | SEQ ID NO 1642 |
| NM_016411 | SEQ ID NO 1643 |
| NM_016423 | SEQ ID NO 1644 |
| NM_016463 | SEQ ID NO 1647 |
| NM_016475 | SEQ ID NO 1649 |
| NM_016477 | SEQ ID NO 1650 |
| NM_016491 | SEQ ID NO 1651 |
| NM_016495 | SEQ ID NO 1652 |
| NM_016542 | SEQ ID NO 1653 |
| NM_016548 | SEQ ID NO 1654 |
| NM_016569 | SEQ ID NO 1655 |
| NM_016577 | SEQ ID NO 1656 |
| NM_016582 | SEQ ID NO 1657 |
| NM_016593 | SEQ ID NO 1658 |
| NM_016603 | SEQ ID NO 1659 |
| NM_016612 | SEQ ID NO 1660 |
| NM_016619 | SEQ ID NO 1661 |
| NM_016623 | SEQ ID NO 1663 |
| NM_016625 | SEQ ID NO 1664 |
| NM_016629 | SEQ ID NO 1665 |
| NM_016640 | SEQ ID NO 1666 |
| NM_016645 | SEQ ID NO 1667 |
| NM_016650 | SEQ ID NO 1668 |
| NM_016657 | SEQ ID NO 1669 |
| NM_016733 | SEQ ID NO 1670 |
| NM_016815 | SEQ ID NO 1671 |
| NM_016817 | SEQ ID NO 1672 |
| NM_016818 | SEQ ID NO 1673 |
| NM_016839 | SEQ ID NO 1675 |
| NM_017414 | SEQ ID NO 1676 |
| NM_017422 | SEQ ID NO 1677 |
| NM_017423 | SEQ ID NO 1678 |
| NM_017447 | SEQ ID NO 1679 |
| NM_017518 | SEQ ID NO 1680 |
| NM_017522 | SEQ ID NO 1681 |
| NM_017540 | SEQ ID NO 1682 |
| NM_017555 | SEQ ID NO 1683 |
| NM_017572 | SEQ ID NO 1684 |
| NM_017585 | SEQ ID NO 1685 |
| NM_017586 | SEQ ID NO 1686 |
| NM_017596 | SEQ ID NO 1687 |
| NM_017606 | SEQ ID NO 1688 |
| NM_017617 | SEQ ID NO 1689 |
| NM_017633 | SEQ ID NO 1690 |
| NM_017634 | SEQ ID NO 1691 |
| NM_017646 | SEQ ID NO 1692 |
| NM_017660 | SEQ ID NO 1693 |
| NM_017680 | SEQ ID NO 1694 |
| NM_017691 | SEQ ID NO 1695 |
| NM_017698 | SEQ ID NO 1696 |
| NM_017702 | SEQ ID NO 1697 |
| NM_017731 | SEQ ID NO 1699 |
| NM_017732 | SEQ ID NO 1700 |
| NM_017733 | SEQ ID NO 1701 |
| NM_017734 | SEQ ID NO 1702 |
| NM_017746 | SEQ ID NO 1703 |
| NM_017750 | SEQ ID NO 1704 |
| NM_017761 | SEQ ID NO 1705 |
| NM_017763 | SEQ ID NO 1706 |
| NM_017770 | SEQ ID NO 1707 |
| NM_017779 | SEQ ID NO 1708 |
| NM_017780 | SEQ ID NO 1709 |
| NM_017782 | SEQ ID NO 1710 |
| NM_017786 | SEQ ID NO 1711 |
| NM_017791 | SEQ ID NO 1712 |
| NM_017805 | SEQ ID NO 1713 |
| NM_017816 | SEQ ID NO 1714 |
| NM_017821 | SEQ ID NO 1715 |
| NM_017835 | SEQ ID NO 1716 |
| NM_017843 | SEQ ID NO 1717 |
| NM_017857 | SEQ ID NO 1718 |
| NM_017901 | SEQ ID NO 1719 |
| NM_017906 | SEQ ID NO 1720 |
| NM_017918 | SEQ ID NO 1721 |
| NM_017961 | SEQ ID NO 1722 |
| NM_017996 | SEQ ID NO 1723 |
| NM_018000 | SEQ ID NO 1724 |
| NM_018004 | SEQ ID NO 1725 |
| NM_018011 | SEQ ID NO 1726 |
| NM_018014 | SEQ ID NO 1727 |
| NM_018022 | SEQ ID NO 1728 |
| NM_018031 | SEQ ID NO 1729 |
| NM_018043 | SEQ ID NO 1730 |
| NM_018048 | SEQ ID NO 1731 |
| NM_018062 | SEQ ID NO 1732 |
| NM_018069 | SEQ ID NO 1733 |
| NM_018072 | SEQ ID NO 1734 |
| NM_018077 | SEQ ID NO 1735 |
| NM_018086 | SEQ ID NO 1736 |
| NM_018087 | SEQ ID NO 1737 |
| NM_018093 | SEQ ID NO 1738 |
| NM_018098 | SEQ ID NO 1739 |
| NM_018099 | SEQ ID NO 1740 |
| NM_018101 | SEQ ID NO 1741 |
| NM_018103 | SEQ ID NO 1742 |
| NM_018109 | SEQ ID NO 1744 |
| NM_018123 | SEQ ID NO 1746 |
| NM_018131 | SEQ ID NO 1747 |
| NM_018136 | SEQ ID NO 1748 |
| NM_018138 | SEQ ID NO 1749 |
| NM_018166 | SEQ ID NO 1750 |
| NM_018171 | SEQ ID NO 1751 |
| NM_018178 | SEQ ID NO 1752 |
| NM_018181 | SEQ ID NO 1753 |
| NM_018186 | SEQ ID NO 1754 |
| NM_018188 | SEQ ID NO 1756 |
| NM_018194 | SEQ ID NO 1757 |
| NM_018204 | SEQ ID NO 1758 |
| NM_018208 | SEQ ID NO 1759 |
| NM_018212 | SEQ ID NO 1760 |
| NM_018234 | SEQ ID NO 1763 |

TABLE 1-continued 2,460 gene markers that distinguish ER(+) and ER(−) cell samples.

| GenBank Accession Number | SEQ ID NO |
|---|---|
| NM_018255 | SEQ ID NO 1764 |
| NM_018257 | SEQ ID NO 1765 |
| NM_018265 | SEQ ID NO 1766 |
| NM_018271 | SEQ ID NO 1767 |
| NM_018290 | SEQ ID NO 1768 |
| NM_018295 | SEQ ID NO 1769 |
| NM_018304 | SEQ ID NO 1770 |
| NM_018306 | SEQ ID NO 1771 |
| NM_018326 | SEQ ID NO 1772 |
| NM_018346 | SEQ ID NO 1773 |
| NM_018366 | SEQ ID NO 1775 |
| NM_018370 | SEQ ID NO 1776 |
| NM_018373 | SEQ ID NO 1777 |
| NM_018379 | SEQ ID NO 1778 |
| NM_018384 | SEQ ID NO 1779 |
| NM_018389 | SEQ ID NO 1780 |
| NM_018410 | SEQ ID NO 1783 |
| NM_018439 | SEQ ID NO 1785 |
| NM_018454 | SEQ ID NO 1786 |
| NM_018455 | SEQ ID NO 1787 |
| NM_018465 | SEQ ID NO 1788 |
| NM_018471 | SEQ ID NO 1789 |
| NM_018478 | SEQ ID NO 1790 |
| NM_018479 | SEQ ID NO 1791 |
| NM_018529 | SEQ ID NO 1793 |
| NM_018556 | SEQ ID NO 1794 |
| NM_018569 | SEQ ID NO 1795 |
| NM_018584 | SEQ ID NO 1796 |
| NM_018653 | SEQ ID NO 1797 |
| NM_018660 | SEQ ID NO 1798 |
| NM_018683 | SEQ ID NO 1799 |
| NM_018685 | SEQ ID NO 1800 |
| NM_018686 | SEQ ID NO 1801 |
| NM_018695 | SEQ ID NO 1802 |
| NM_018728 | SEQ ID NO 1803 |
| NM_018840 | SEQ ID NO 1804 |
| NM_018842 | SEQ ID NO 1805 |
| NM_018950 | SEQ ID NO 1806 |
| NM_018988 | SEQ ID NO 1807 |
| NM_019000 | SEQ ID NO 1808 |
| NM_019013 | SEQ ID NO 1809 |
| NM_019025 | SEQ ID NO 1810 |
| NM_019027 | SEQ ID NO 1811 |
| NM_019041 | SEQ ID NO 1812 |
| NM_019044 | SEQ ID NO 1813 |
| NM_019063 | SEQ ID NO 1815 |
| NM_019084 | SEQ ID NO 1816 |
| NM_019554 | SEQ ID NO 1817 |
| NM_019845 | SEQ ID NO 1818 |
| NM_019858 | SEQ ID NO 1819 |
| NM_020130 | SEQ ID NO 1820 |
| NM_020133 | SEQ ID NO 1821 |
| NM_020143 | SEQ ID NO 1822 |
| NM_020150 | SEQ ID NO 1823 |
| NM_020163 | SEQ ID NO 1824 |
| NM_020166 | SEQ ID NO 1825 |
| NM_020169 | SEQ ID NO 1826 |
| NM_020179 | SEQ ID NO 1827 |
| NM_020184 | SEQ ID NO 1828 |
| NM_020186 | SEQ ID NO 1829 |
| NM_020188 | SEQ ID NO 1830 |
| NM_020189 | SEQ ID NO 1831 |
| NM_020197 | SEQ ID NO 1832 |
| NM_020199 | SEQ ID NO 1833 |
| NM_020215 | SEQ ID NO 1834 |
| NM_020347 | SEQ ID NO 1836 |
| NM_020365 | SEQ ID NO 1837 |
| NM_020386 | SEQ ID NO 1838 |
| NM_020445 | SEQ ID NO 1839 |
| NM_020639 | SEQ ID NO 1840 |
| NM_020659 | SEQ ID NO 1841 |
| NM_020675 | SEQ ID NO 1842 |
| NM_020686 | SEQ ID NO 1843 |
| NM_020974 | SEQ ID NO 1844 |
| NM_020978 | SEQ ID NO 1845 |
| NM_020979 | SEQ ID NO 1846 |
| NM_020980 | SEQ ID NO 1847 |
| NM_021000 | SEQ ID NO 1849 |
| NM_021004 | SEQ ID NO 1850 |
| NM_021025 | SEQ ID NO 1851 |
| NM_021063 | SEQ ID NO 1852 |
| NM_021065 | SEQ ID NO 1853 |
| NM_021077 | SEQ ID NO 1854 |
| NM_021095 | SEQ ID NO 1855 |
| NM_021101 | SEQ ID NO 1856 |
| NM_021103 | SEQ ID NO 1857 |
| NM_021128 | SEQ ID NO 1858 |
| NM_021147 | SEQ ID NO 1859 |
| NM_021151 | SEQ ID NO 1860 |
| NM_021181 | SEQ ID NO 1861 |
| NM_021190 | SEQ ID NO 1862 |
| NM_021198 | SEQ ID NO 1863 |
| NM_021200 | SEQ ID NO 1864 |
| NM_021203 | SEQ ID NO 1865 |
| NM_021238 | SEQ ID NO 1866 |
| NM_021242 | SEQ ID NO 1867 |
| S40706 | SEQ ID NO 1869 |
| S53354 | SEQ ID NO 1870 |
| S59184 | SEQ ID NO 1871 |
| S62138 | SEQ ID NO 1872 |
| U09848 | SEQ ID NO 1873 |
| U10991 | SEQ ID NO 1874 |
| U17077 | SEQ ID NO 1875 |
| U18919 | SEQ ID NO 1876 |
| U41387 | SEQ ID NO 1877 |
| U45975 | SEQ ID NO 1878 |
| U49835 | SEQ ID NO 1879 |
| U56725 | SEQ ID NO 1880 |
| U58033 | SEQ ID NO 1881 |
| U61167 | SEQ ID NO 1882 |
| U66042 | SEQ ID NO 1883 |
| U68385 | SEQ ID NO 1885 |
| U68494 | SEQ ID NO 1886 |
| U74612 | SEQ ID NO 1887 |
| U75968 | SEQ ID NO 1888 |
| U79293 | SEQ ID NO 1889 |
| U80736 | SEQ ID NO 1890 |
| U82987 | SEQ ID NO 1891 |
| U83115 | SEQ ID NO 1892 |
| U89715 | SEQ ID NO 1893 |
| U90916 | SEQ ID NO 1894 |
| U92544 | SEQ ID NO 1895 |
| U96131 | SEQ ID NO 1896 |
| U96394 | SEQ ID NO 1897 |
| W61000_RC | SEQ ID NO 1898 |
| X00437 | SEQ ID NO 1899 |
| X00497 | SEQ ID NO 1900 |
| X01394 | SEQ ID NO 1901 |
| X03084 | SEQ ID NO 1902 |
| X07834 | SEQ ID NO 1905 |
| X14356 | SEQ ID NO 1906 |
| X16302 | SEQ ID NO 1907 |
| X52486 | SEQ ID NO 1909 |
| X52882 | SEQ ID NO 1910 |
| X56807 | SEQ ID NO 1911 |
| X57809 | SEQ ID NO 1912 |
| X57819 | SEQ ID NO 1913 |
| X58529 | SEQ ID NO 1914 |
| X59405 | SEQ ID NO 1915 |
| X72475 | SEQ ID NO 1918 |
| X73617 | SEQ ID NO 1919 |
| X74794 | SEQ ID NO 1920 |
| X75315 | SEQ ID NO 1921 |
| X79782 | SEQ ID NO 1922 |
| X82693 | SEQ ID NO 1923 |
| X83301 | SEQ ID NO 1924 |

TABLE 1-continued 2,460 gene markers that distinguish ER(+) and ER(−) cell samples.

| GenBank Accession Number | SEQ ID NO |
|---|---|
| X93006 | SEQ ID NO 1926 |
| X94232 | SEQ ID NO 1927 |
| X98834 | SEQ ID NO 1929 |
| X99142 | SEQ ID NO 1930 |
| Y14737 | SEQ ID NO 1932 |
| Z11887 | SEQ ID NO 1933 |
| Z48633 | SEQ ID NO 1935 |
| NM_004222 | SEQ ID NO 1936 |
| NM_016405 | SEQ ID NO 1937 |
| NM_017690 | SEQ ID NO 1938 |
| Contig29_RC | SEQ ID NO 1939 |
| Contig237_RC | SEQ ID NO 1940 |
| Contig263_RC | SEQ ID NO 1941 |
| Contig292_RC | SEQ ID NO 1942 |
| Contig382_RC | SEQ ID NO 1944 |
| Contig399_RC | SEQ ID NO 1945 |
| Contig448_RC | SEQ ID NO 1946 |
| Contig569_RC | SEQ ID NO 1947 |
| Contig580_RC | SEQ ID NO 1948 |
| Contig678_RC | SEQ ID NO 1949 |
| Contig706_RC | SEQ ID NO 1950 |
| Contig718_RC | SEQ ID NO 1951 |
| Contig719_RC | SEQ ID NO 1952 |
| Contig742_RC | SEQ ID NO 1953 |
| Contig753_RC | SEQ ID NO 1954 |
| Contig758_RC | SEQ ID NO 1956 |
| Contig760_RC | SEQ ID NO 1957 |
| Contig842_RC | SEQ ID NO 1958 |
| Contig848_RC | SEQ ID NO 1959 |
| Contig924_RC | SEQ ID NO 1960 |
| Contig974_RC | SEQ ID NO 1961 |
| Contig1018_RC | SEQ ID NO 1962 |
| Contig1056_RC | SEQ ID NO 1963 |
| Contig1061_RC | SEQ ID NO 1964 |
| Contig1129_RC | SEQ ID NO 1965 |
| Contig1148 | SEQ ID NO 1966 |
| Contig1239_RC | SEQ ID NO 1967 |
| Contig1277 | SEQ ID NO 1968 |
| Contig1333_RC | SEQ ID NO 1969 |
| Contig1386_RC | SEQ ID NO 1970 |
| Contig1389_RC | SEQ ID NO 1971 |
| Contig1418_RC | SEQ ID NO 1972 |
| Contig1462_RC | SEQ ID NO 1973 |
| Contig1505_RC | SEQ ID NO 1974 |
| Contig1540_RC | SEQ ID NO 1975 |
| Contig1584_RC | SEQ ID NO 1976 |
| Contig1632_RC | SEQ ID NO 1977 |
| Contig1682_RC | SEQ ID NO 1978 |
| Contig1778_RC | SEQ ID NO 1979 |
| Contig1829 | SEQ ID NO 1981 |
| Contig1838_RC | SEQ ID NO 1982 |
| Contig1938_RC | SEQ ID NO 1983 |
| Contig1970_RC | SEQ ID NO 1984 |
| Contig1998_RC | SEQ ID NO 1985 |
| Contig2099_RC | SEQ ID NO 1986 |
| Contig2143_RC | SEQ ID NO 1987 |
| Contig2237_RC | SEQ ID NO 1988 |
| Contig2429_RC | SEQ ID NO 1990 |
| Contig2504_RC | SEQ ID NO 1991 |
| Contig2512_RC | SEQ ID NO 1992 |
| Contig2575_RC | SEQ ID NO 1993 |
| Contig2578_RC | SEQ ID NO 1994 |
| Contig2639_RC | SEQ ID NO 1995 |
| Contig2647_RC | SEQ ID NO 1996 |
| Contig2657_RC | SEQ ID NO 1997 |
| Contig2728_RC | SEQ ID NO 1998 |
| Contig2745_RC | SEQ ID NO 1999 |
| Contig2811_RC | SEQ ID NO 2000 |
| Contig2873_RC | SEQ ID NO 2001 |
| Contig2883_RC | SEQ ID NO 2002 |
| Contig2915_RC | SEQ ID NO 2003 |
| Contig2928_RC | SEQ ID NO 2004 |
| Contig3024_RC | SEQ ID NO 2005 |
| Contig3094_RC | SEQ ID NO 2006 |
| Contig3164_RC | SEQ ID NO 2007 |
| Contig3495_RC | SEQ ID NO 2009 |
| Contig3607_RC | SEQ ID NO 2010 |
| Contig3659_RC | SEQ ID NO 2011 |
| Contig3677_RC | SEQ ID NO 2012 |
| Contig3682_RC | SEQ ID NO 2013 |
| Contig3734_RC | SEQ ID NO 2014 |
| Contig3834_RC | SEQ ID NO 2015 |
| Contig3876_RC | SEQ ID NO 2016 |
| Contig3902_RC | SEQ ID NO 2017 |
| Contig3940_RC | SEQ ID NO 2018 |
| Contig4380_RC | SEQ ID NO 2019 |
| Contig4388_RC | SEQ ID NO 2020 |
| Contig4467_RC | SEQ ID NO 2021 |
| Contig4949_RC | SEQ ID NO 2023 |
| Contig5348_RC | SEQ ID NO 2024 |
| Contig5403_RC | SEQ ID NO 2025 |
| Contig5716_RC | SEQ ID NO 2026 |
| Contig6118_RC | SEQ ID NO 2027 |
| Contig6164_RC | SEQ ID NO 2028 |
| Contig6181_RC | SEQ ID NO 2029 |
| Contig6514_RC | SEQ ID NO 2030 |
| Contig6612_RC | SEQ ID NO 2031 |
| Contig6881_RC | SEQ ID NO 2032 |
| Contig8165_RC | SEQ ID NO 2033 |
| Contig8221_RC | SEQ ID NO 2034 |
| Contig8347_RC | SEQ ID NO 2035 |
| Contig8364_RC | SEQ ID NO 2036 |
| Contig8888_RC | SEQ ID NO 2038 |
| Contig9259_RC | SEQ ID NO 2039 |
| Contig9541_RC | SEQ ID NO 2040 |
| Contig10268_RC | SEQ ID NO 2041 |
| Contig10363_RC | SEQ ID NO 2042 |
| Contig10437_RC | SEQ ID NO 2043 |
| Contig11086_RC | SEQ ID NO 2045 |
| Contig11275_RC | SEQ ID NO 2046 |
| Contig11648_RC | SEQ ID NO 2047 |
| Contig12216_RC | SEQ ID NO 2048 |
| Contig12369_RC | SEQ ID NO 2049 |
| Contig12814_RC | SEQ ID NO 2050 |
| Contig12951_RC | SEQ ID NO 2051 |
| Contig13480_RC | SEQ ID NO 2052 |
| Contig14284_RC | SEQ ID NO 2053 |
| Contig14390_RC | SEQ ID NO 2054 |
| Contig14780_RC | SEQ ID NO 2055 |
| Contig14954_RC | SEQ ID NO 2056 |
| Contig14981_RC | SEQ ID NO 2057 |
| Contig15692_RC | SEQ ID NO 2058 |
| Contig16192_RC | SEQ ID NO 2059 |
| Contig16759_RC | SEQ ID NO 2061 |
| Contig16786_RC | SEQ ID NO 2062 |
| Contig16905_RC | SEQ ID NO 2063 |
| Contig17103_RC | SEQ ID NO 2064 |
| Contig17105_RC | SEQ ID NO 2065 |
| Contig17248_RC | SEQ ID NO 2066 |
| Contig17345_RC | SEQ ID NO 2067 |
| Contig18502_RC | SEQ ID NO 2069 |
| Contig20156_RC | SEQ ID NO 2071 |
| Contig20302_RC | SEQ ID NO 2073 |
| Contig20600_RC | SEQ ID NO 2074 |
| Contig20617_RC | SEQ ID NO 2075 |
| Contig20629_RC | SEQ ID NO 2076 |
| Contig20651_RC | SEQ ID NO 2077 |
| Contig21130_RC | SEQ ID NO 2078 |
| Contig21185_RC | SEQ ID NO 2079 |
| Contig21421_RC | SEQ ID NO 2080 |
| Contig21787_RC | SEQ ID NO 2081 |
| Contig21812_RC | SEQ ID NO 2082 |
| Contig22418_RC | SEQ ID NO 2083 |
| Contig23085_RC | SEQ ID NO 2084 |
| Contig23454_RC | SEQ ID NO 2085 |
| Contig24138_RC | SEQ ID NO 2086 |

TABLE 1-continued 2,460 gene markers that distinguish ER(+) and ER(−) cell samples.

| GenBank Accession Number | SEQ ID NO |
|---|---|
| Contig24252_RC | SEQ ID NO 2087 |
| Contig24655_RC | SEQ ID NO 2089 |
| Contig25055_RC | SEQ ID NO 2090 |
| Contig25290_RC | SEQ ID NO 2091 |
| Contig25343_RC | SEQ ID NO 2092 |
| Contig25362_RC | SEQ ID NO 2093 |
| Contig25617_RC | SEQ ID NO 2094 |
| Contig25659_RC | SEQ ID NO 2095 |
| Contig25722_RC | SEQ ID NO 2096 |
| Contig25809_RC | SEQ ID NO 2097 |
| Contig25991 | SEQ ID NO 2098 |
| Contig26022_RC | SEQ ID NO 2099 |
| Contig26077_RC | SEQ ID NO 2100 |
| Contig26310_RC | SEQ ID NO 2101 |
| Contig26371_RC | SEQ ID NO 2102 |
| Contig26438_RC | SEQ ID NO 2103 |
| Contig26706_RC | SEQ ID NO 2104 |
| Contig27088_RC | SEQ ID NO 2105 |
| Contig27186_RC | SEQ ID NO 2106 |
| Contig27228_RC | SEQ ID NO 2107 |
| Contig27344_RC | SEQ ID NO 2109 |
| Contig27386_RC | SEQ ID NO 2110 |
| Contig27624_RC | SEQ ID NO 2111 |
| Contig27749_RC | SEQ ID NO 2112 |
| Contig27882_RC | SEQ ID NO 2113 |
| Contig27915_RC | SEQ ID NO 2114 |
| Contig28030_RC | SEQ ID NO 2115 |
| Contig28081_RC | SEQ ID NO 2116 |
| Contig28152_RC | SEQ ID NO 2117 |
| Contig28550_RC | SEQ ID NO 2119 |
| Contig28552_RC | SEQ ID NO 2120 |
| Contig28712_RC | SEQ ID NO 2121 |
| Contig28888_RC | SEQ ID NO 2122 |
| Contig28947_RC | SEQ ID NO 2123 |
| Contig29126_RC | SEQ ID NO 2124 |
| Contig29193_RC | SEQ ID NO 2125 |
| Contig29369_RC | SEQ ID NO 2126 |
| Contig29639_RC | SEQ ID NO 2127 |
| Contig30047_RC | SEQ ID NO 2129 |
| Contig30154_RC | SEQ ID NO 2131 |
| Contig30209_RC | SEQ ID NO 2132 |
| Contig30213_RC | SEQ ID NO 2133 |
| Contig30230_RC | SEQ ID NO 2134 |
| Contig30267_RC | SEQ ID NO 2135 |
| Contig30390_RC | SEQ ID NO 2136 |
| Contig30480_RC | SEQ ID NO 2137 |
| Contig30609_RC | SEQ ID NO 2138 |
| Contig30934_RC | SEQ ID NO 2139 |
| Contig31150_RC | SEQ ID NO 2140 |
| Contig31186_RC | SEQ ID NO 2141 |
| Contig31251_RC | SEQ ID NO 2142 |
| Contig31288_RC | SEQ ID NO 2143 |
| Contig31291_RC | SEQ ID NO 2144 |
| Contig31295_RC | SEQ ID NO 2145 |
| Contig31424_RC | SEQ ID NO 2146 |
| Contig31449_RC | SEQ ID NO 2147 |
| Contig31596_RC | SEQ ID NO 2148 |
| Contig31864_RC | SEQ ID NO 2149 |
| Contig31928_RC | SEQ ID NO 2150 |
| Contig31966_RC | SEQ ID NO 2151 |
| Contig31986_RC | SEQ ID NO 2152 |
| Contig32084_RC | SEQ ID NO 2153 |
| Contig32105_RC | SEQ ID NO 2154 |
| Contig32185_RC | SEQ ID NO 2156 |
| Contig32242_RC | SEQ ID NO 2157 |
| Contig32322_RC | SEQ ID NO 2158 |
| Contig32336_RC | SEQ ID NO 2159 |
| Contig32558_RC | SEQ ID NO 2160 |
| Contig32798_RC | SEQ ID NO 2161 |
| Contig33005_RC | SEQ ID NO 2162 |
| Contig33230_RC | SEQ ID NO 2163 |
| Contig33260_RC | SEQ ID NO 2164 |
| Contig33654_RC | SEQ ID NO 2166 |
| Contig33741_RC | SEQ ID NO 2167 |
| Contig33771_RC | SEQ ID NO 2168 |
| Contig33814_RC | SEQ ID NO 2169 |
| Contig33815_RC | SEQ ID NO 2170 |
| Contig33833 | SEQ ID NO 2171 |
| Contig33998_RC | SEQ ID NO 2172 |
| Contig34079 | SEQ ID NO 2173 |
| Contig34080_RC | SEQ ID NO 2174 |
| Contig34222_RC | SEQ ID NO 2175 |
| Contig34233_RC | SEQ ID NO 2176 |
| Contig34303_RC | SEQ ID NO 2177 |
| Contig34393_RC | SEQ ID NO 2178 |
| Contig34477_RC | SEQ ID NO 2179 |
| Contig34766_RC | SEQ ID NO 2181 |
| Contig34952 | SEQ ID NO 2182 |
| Contig34989_RC | SEQ ID NO 2183 |
| Contig35030_RC | SEQ ID NO 2184 |
| Contig35251_RC | SEQ ID NO 2185 |
| Contig35629_RC | SEQ ID NO 2186 |
| Contig35635_RC | SEQ ID NO 2187 |
| Contig35763_RC | SEQ ID NO 2188 |
| Contig35814_RC | SEQ ID NO 2189 |
| Contig35896_RC | SEQ ID NO 2190 |
| Contig35976_RC | SEQ ID NO 2191 |
| Contig36042_RC | SEQ ID NO 2192 |
| Contig36081_RC | SEQ ID NO 2193 |
| Contig36152_RC | SEQ ID NO 2194 |
| Contig36193_RC | SEQ ID NO 2195 |
| Contig36312_RC | SEQ ID NO 2196 |
| Contig36323_RC | SEQ ID NO 2197 |
| Contig36339_RC | SEQ ID NO 2198 |
| Contig36647_RC | SEQ ID NO 2199 |
| Contig36744_RC | SEQ ID NO 2200 |
| Contig36761_RC | SEQ ID NO 2201 |
| Contig36879_RC | SEQ ID NO 2202 |
| Contig36900_RC | SEQ ID NO 2203 |
| Contig37015_RC | SEQ ID NO 2204 |
| Contig37024_RC | SEQ ID NO 2205 |
| Contig37072_RC | SEQ ID NO 2207 |
| Contig37140_RC | SEQ ID NO 2208 |
| Contig37141_RC | SEQ ID NO 2209 |
| Contig37204_RC | SEQ ID NO 2210 |
| Contig37281_RC | SEQ ID NO 2211 |
| Contig37287_RC | SEQ ID NO 2212 |
| Contig37439_RC | SEQ ID NO 2213 |
| Contig37562_RC | SEQ ID NO 2214 |
| Contig37571_RC | SEQ ID NO 2215 |
| Contig37598 | SEQ ID NO 2216 |
| Contig37758_RC | SEQ ID NO 2217 |
| Contig37778_RC | SEQ ID NO 2218 |
| Contig37884_RC | SEQ ID NO 2219 |
| Contig37946_RC | SEQ ID NO 2220 |
| Contig38170_RC | SEQ ID NO 2221 |
| Contig38288_RC | SEQ ID NO 2223 |
| Contig38398_RC | SEQ ID NO 2224 |
| Contig38580_RC | SEQ ID NO 2226 |
| Contig38630_RC | SEQ ID NO 2227 |
| Contig38652_RC | SEQ ID NO 2228 |
| Contig38683_RC | SEQ ID NO 2229 |
| Contig38726_RC | SEQ ID NO 2230 |
| Contig38791_RC | SEQ ID NO 2231 |
| Contig38901_RC | SEQ ID NO 2232 |
| Contig38983_RC | SEQ ID NO 2233 |
| Contig39090_RC | SEQ ID NO 2234 |
| Contig39132_RC | SEQ ID NO 2235 |
| Contig39157_RC | SEQ ID NO 2236 |
| Contig39226_RC | SEQ ID NO 2237 |
| Contig39285_RC | SEQ ID NO 2238 |
| Contig39556_RC | SEQ ID NO 2239 |
| Contig39591_RC | SEQ ID NO 2240 |
| Contig39826_RC | SEQ ID NO 2241 |
| Contig39845_RC | SEQ ID NO 2242 |
| Contig39891_RC | SEQ ID NO 2243 |

TABLE 1-continued 2,460 gene markers that distinguish ER(+) and ER(−) cell samples.

| GenBank Accession Number | SEQ ID NO |
|---|---|
| Contig39922_RC | SEQ ID NO 2244 |
| Contig39960_RC | SEQ ID NO 2245 |
| Contig40026_RC | SEQ ID NO 2246 |
| Contig40121_RC | SEQ ID NO 2247 |
| Contig40128_RC | SEQ ID NO 2248 |
| Contig40146 | SEQ ID NO 2249 |
| Contig40208_RC | SEQ ID NO 2250 |
| Contig40212_RC | SEQ ID NO 2251 |
| Contig40238_RC | SEQ ID NO 2252 |
| Contig40434_RC | SEQ ID NO 2253 |
| Contig40446_RC | SEQ ID NO 2254 |
| Contig40500_RC | SEQ ID NO 2255 |
| Contig40573_RC | SEQ ID NO 2256 |
| Contig40813_RC | SEQ ID NO 2258 |
| Contig40816_RC | SEQ ID NO 2259 |
| Contig40845_RC | SEQ ID NO 2261 |
| Contig40889_RC | SEQ ID NO 2262 |
| Contig41035 | SEQ ID NO 2263 |
| Contig41234_RC | SEQ ID NO 2264 |
| Contig41413_RC | SEQ ID NO 2266 |
| Contig41521_RC | SEQ ID NO 2267 |
| Contig41530_RC | SEQ ID NO 2268 |
| Contig41590 | SEQ ID NO 2269 |
| Contig41618_RC | SEQ ID NO 2270 |
| Contig41624_RC | SEQ ID NO 2271 |
| Contig41635_RC | SEQ ID NO 2272 |
| Contig41676_RC | SEQ ID NO 2273 |
| Contig41689_RC | SEQ ID NO 2274 |
| Contig41804_RC | SEQ ID NO 2275 |
| Contig41887_RC | SEQ ID NO 2276 |
| Contig41905_RC | SEQ ID NO 2277 |
| Contig41954_RC | SEQ ID NO 2278 |
| Contig41983_RC | SEQ ID NO 2279 |
| Contig42006_RC | SEQ ID NO 2280 |
| Contig42014_RC | SEQ ID NO 2281 |
| Contig42036_RC | SEQ ID NO 2282 |
| Contig42041_RC | SEQ ID NO 2283 |
| Contig42139 | SEQ ID NO 2284 |
| Contig42161_RC | SEQ ID NO 2285 |
| Contig42220_RC | SEQ ID NO 2286 |
| Contig42306_RC | SEQ ID NO 2287 |
| Contig42311_RC | SEQ ID NO 2288 |
| Contig42313_RC | SEQ ID NO 2289 |
| Contig42402_RC | SEQ ID NO 2290 |
| Contig42421_RC | SEQ ID NO 2291 |
| Contig42430_RC | SEQ ID NO 2292 |
| Contig42431_RC | SEQ ID NO 2293 |
| Contig42542_RC | SEQ ID NO 2294 |
| Contig42582 | SEQ ID NO 2295 |
| Contig42631_RC | SEQ ID NO 2296 |
| Contig42751_RC | SEQ ID NO 2297 |
| Contig42759_RC | SEQ ID NO 2298 |
| Contig43054 | SEQ ID NO 2299 |
| Contig43079_RC | SEQ ID NO 2300 |
| Contig43195_RC | SEQ ID NO 2301 |
| Contig43368_RC | SEQ ID NO 2302 |
| Contig43410_RC | SEQ ID NO 2303 |
| Contig43476_RC | SEQ ID NO 2304 |
| Contig43549_RC | SEQ ID NO 2305 |
| Contig43645_RC | SEQ ID NO 2306 |
| Contig43648_RC | SEQ ID NO 2307 |
| Contig43673_RC | SEQ ID NO 2308 |
| Contig43679_RC | SEQ ID NO 2309 |
| Contig43694_RC | SEQ ID NO 2310 |
| Contig43747_RC | SEQ ID NO 2311 |
| Contig43918_RC | SEQ ID NO 2312 |
| Contig43983_RC | SEQ ID NO 2313 |
| Contig44040_RC | SEQ ID NO 2314 |
| Contig44064_RC | SEQ ID NO 2315 |
| Contig44195_RC | SEQ ID NO 2316 |
| Contig44226_RC | SEQ ID NO 2317 |
| Contig44289_RC | SEQ ID NO 2320 |
| Contig44310_RC | SEQ ID NO 2321 |
| Contig44409 | SEQ ID NO 2322 |
| Contig44413_RC | SEQ ID NO 2323 |
| Contig44451_RC | SEQ ID NO 2324 |
| Contig44585_RC | SEQ ID NO 2325 |
| Contig44656_RC | SEQ ID NO 2326 |
| Contig44703_RC | SEQ ID NO 2327 |
| Contig44708_RC | SEQ ID NO 2328 |
| Contig44757_RC | SEQ ID NO 2329 |
| Contig44829_RC | SEQ ID NO 2331 |
| Contig44870 | SEQ ID NO 2332 |
| Contig44893_RC | SEQ ID NO 2333 |
| Contig44909_RC | SEQ ID NO 2334 |
| Contig44939_RC | SEQ ID NO 2335 |
| Contig45022_RC | SEQ ID NO 2336 |
| Contig45032_RC | SEQ ID NO 2337 |
| Contig45041_RC | SEQ ID NO 2338 |
| Contig45049_RC | SEQ ID NO 2339 |
| Contig45090_RC | SEQ ID NO 2340 |
| Contig45156_RC | SEQ ID NO 2341 |
| Contig45316_RC | SEQ ID NO 2342 |
| Contig45321 | SEQ ID NO 2343 |
| Contig45375_RC | SEQ ID NO 2345 |
| Contig45443_RC | SEQ ID NO 2346 |
| Contig45454_RC | SEQ ID NO 2347 |
| Contig45537_RC | SEQ ID NO 2348 |
| Contig45588_RC | SEQ ID NO 2349 |
| Contig45708_RC | SEQ ID NO 2350 |
| Contig45816_RC | SEQ ID NO 2351 |
| Contig45847_RC | SEQ ID NO 2352 |
| Contig45891_RC | SEQ ID NO 2353 |
| Contig46056_RC | SEQ ID NO 2354 |
| Contig46062_RC | SEQ ID NO 2355 |
| Contig46075_RC | SEQ ID NO 2356 |
| Contig46164_RC | SEQ ID NO 2357 |
| Contig46218_RC | SEQ ID NO 2358 |
| Contig46223_RC | SEQ ID NO 2359 |
| Contig46244_RC | SEQ ID NO 2360 |
| Contig46262_RC | SEQ ID NO 2361 |
| Contig46362_RC | SEQ ID NO 2364 |
| Contig46443_RC | SEQ ID NO 2365 |
| Contig46553_RC | SEQ ID NO 2367 |
| Contig46597_RC | SEQ ID NO 2368 |
| Contig46653_RC | SEQ ID NO 2369 |
| Contig46709_RC | SEQ ID NO 2370 |
| Contig46777_RC | SEQ ID NO 2371 |
| Contig46802_RC | SEQ ID NO 2372 |
| Contig46890_RC | SEQ ID NO 2374 |
| Contig46922_RC | SEQ ID NO 2375 |
| Contig46934_RC | SEQ ID NO 2376 |
| Contig46937_RC | SEQ ID NO 2377 |
| Contig46991_RC | SEQ ID NO 2378 |
| Contig47016_RC | SEQ ID NO 2379 |
| Contig47045_RC | SEQ ID NO 2380 |
| Contig47106_RC | SEQ ID NO 2381 |
| Contig47146_RC | SEQ ID NO 2382 |
| Contig47230_RC | SEQ ID NO 2383 |
| Contig47405_RC | SEQ ID NO 2384 |
| Contig47456_RC | SEQ ID NO 2385 |
| Contig47465_RC | SEQ ID NO 2386 |
| Contig47498_RC | SEQ ID NO 2387 |
| Contig47578_RC | SEQ ID NO 2388 |
| Contig47645_RC | SEQ ID NO 2389 |
| Contig47680_RC | SEQ ID NO 2390 |
| Contig47781_RC | SEQ ID NO 2391 |
| Contig47814_RC | SEQ ID NO 2392 |
| Contig48004_RC | SEQ ID NO 2393 |
| Contig48043_RC | SEQ ID NO 2394 |
| Contig48057_RC | SEQ ID NO 2395 |
| Contig48076_RC | SEQ ID NO 2396 |
| Contig48249_RC | SEQ ID NO 2397 |
| Contig48263_RC | SEQ ID NO 2398 |
| Contig48270_RC | SEQ ID NO 2399 |
| Contig48328_RC | SEQ ID NO 2400 |

TABLE 1-continued 2,460 gene markers that distinguish ER(+) and ER(−) cell samples.

| GenBank Accession Number | SEQ ID NO |
|---|---|
| Contig48518_RC | SEQ ID NO 2401 |
| Contig48572_RC | SEQ ID NO 2402 |
| Contig48659_RC | SEQ ID NO 2403 |
| Contig48722_RC | SEQ ID NO 2404 |
| Contig48774_RC | SEQ ID NO 2405 |
| Contig48776_RC | SEQ ID NO 2406 |
| Contig48800_RC | SEQ ID NO 2407 |
| Contig48806_RC | SEQ ID NO 2408 |
| Contig48852_RC | SEQ ID NO 2409 |
| Contig48900_RC | SEQ ID NO 2410 |
| Contig48913_RC | SEQ ID NO 2411 |
| Contig48970_RC | SEQ ID NO 2413 |
| Contig49058_RC | SEQ ID NO 2414 |
| Contig49063_RC | SEQ ID NO 2415 |
| Contig49093 | SEQ ID NO 2416 |
| Contig49098_RC | SEQ ID NO 2417 |
| Contig49169_RC | SEQ ID NO 2418 |
| Contig49233_RC | SEQ ID NO 2419 |
| Contig49270_RC | SEQ ID NO 2420 |
| Contig49282_RC | SEQ ID NO 2421 |
| Contig49289_RC | SEQ ID NO 2422 |
| Contig49342_RC | SEQ ID NO 2423 |
| Contig49344 | SEQ ID NO 2424 |
| Contig49388_RC | SEQ ID NO 2425 |
| Contig49405_RC | SEQ ID NO 2426 |
| Contig49445_RC | SEQ ID NO 2427 |
| Contig49468_RC | SEQ ID NO 2428 |
| Contig49509_RC | SEQ ID NO 2429 |
| Contig49578_RC | SEQ ID NO 2431 |
| Contig49581_RC | SEQ ID NO 2432 |
| Contig49631_RC | SEQ ID NO 2433 |
| Contig49673_RC | SEQ ID NO 2435 |
| Contig49743_RC | SEQ ID NO 2436 |
| Contig49790_RC | SEQ ID NO 2437 |
| Contig49818_RC | SEQ ID NO 2438 |
| Contig49849_RC | SEQ ID NO 2439 |
| Contig49855 | SEQ ID NO 2440 |
| Contig49910_RC | SEQ ID NO 2441 |
| Contig49948_RC | SEQ ID NO 2442 |
| Contig50004_RC | SEQ ID NO 2443 |
| Contig50094 | SEQ ID NO 2444 |
| Contig50120_RC | SEQ ID NO 2446 |
| Contig50153_RC | SEQ ID NO 2447 |
| Contig50189_RC | SEQ ID NO 2448 |
| Contig50276_RC | SEQ ID NO 2449 |
| Contig50288_RC | SEQ ID NO 2450 |
| Contig50297_RC | SEQ ID NO 2451 |
| Contig50391_RC | SEQ ID NO 2452 |
| Contig50410 | SEQ ID NO 2453 |
| Contig50523_RC | SEQ ID NO 2454 |
| Contig50529 | SEQ ID NO 2455 |
| Contig50588_RC | SEQ ID NO 2456 |
| Contig50592 | SEQ ID NO 2457 |
| Contig50669_RC | SEQ ID NO 2458 |
| Contig50719_RC | SEQ ID NO 2460 |
| Contig50728_RC | SEQ ID NO 2461 |
| Contig50731_RC | SEQ ID NO 2462 |
| Contig50802_RC | SEQ ID NO 2463 |
| Contig50822_RC | SEQ ID NO 2464 |
| Contig50850_RC | SEQ ID NO 2466 |
| Contig50860_RC | SEQ ID NO 2467 |
| Contig50913_RC | SEQ ID NO 2468 |
| Contig50950_RC | SEQ ID NO 2469 |
| Contig51066_RC | SEQ ID NO 2470 |
| Contig51105_RC | SEQ ID NO 2472 |
| Contig51117_RC | SEQ ID NO 2473 |
| Contig51196_RC | SEQ ID NO 2474 |
| Contig51235_RC | SEQ ID NO 2475 |
| Contig51254_RC | SEQ ID NO 2476 |
| Contig51352_RC | SEQ ID NO 2477 |
| Contig51369_RC | SEQ ID NO 2478 |
| Contig51392_RC | SEQ ID NO 2479 |
| Contig51403_RC | SEQ ID NO 2480 |
| Contig51685_RC | SEQ ID NO 2483 |
| Contig51726_RC | SEQ ID NO 2484 |
| Contig51742_RC | SEQ ID NO 2485 |
| Contig51749_RC | SEQ ID NO 2486 |
| Contig51775_RC | SEQ ID NO 2487 |
| Contig51800 | SEQ ID NO 2488 |
| Contig51809_RC | SEQ ID NO 2489 |
| Contig51821_RC | SEQ ID NO 2490 |
| Contig51888_RC | SEQ ID NO 2491 |
| Contig51953_RC | SEQ ID NO 2493 |
| Contig51967_RC | SEQ ID NO 2495 |
| Contig51981_RC | SEQ ID NO 2496 |
| Contig51994_RC | SEQ ID NO 2497 |
| Contig52082_RC | SEQ ID NO 2498 |
| Contig52094_RC | SEQ ID NO 2499 |
| Contig52320 | SEQ ID NO 2500 |
| Contig52398_RC | SEQ ID NO 2501 |
| Contig52425_RC | SEQ ID NO 2503 |
| Contig52482_RC | SEQ ID NO 2504 |
| Contig52543_RC | SEQ ID NO 2505 |
| Contig52553_RC | SEQ ID NO 2506 |
| Contig52579_RC | SEQ ID NO 2507 |
| Contig52603_RC | SEQ ID NO 2508 |
| Contig52639_RC | SEQ ID NO 2509 |
| Contig52641_RC | SEQ ID NO 2510 |
| Contig52684 | SEQ ID NO 2511 |
| Contig52705_RC | SEQ ID NO 2512 |
| Contig52720_RC | SEQ ID NO 2513 |
| Contig52722_RC | SEQ ID NO 2514 |
| Contig52723_RC | SEQ ID NO 2515 |
| Contig52740_RC | SEQ ID NO 2516 |
| Contig52779_RC | SEQ ID NO 2517 |
| Contig52957_RC | SEQ ID NO 2518 |
| Contig52994_RC | SEQ ID NO 2519 |
| Contig53022_RC | SEQ ID NO 2520 |
| Contig53038_RC | SEQ ID NO 2521 |
| Contig53047_RC | SEQ ID NO 2522 |
| Contig53130 | SEQ ID NO 2523 |
| Contig53183_RC | SEQ ID NO 2524 |
| Contig53242_RC | SEQ ID NO 2526 |
| Contig53248_RC | SEQ ID NO 2527 |
| Contig53260_RC | SEQ ID NO 2528 |
| Contig53296_RC | SEQ ID NO 2531 |
| Contig53307_RC | SEQ ID NO 2532 |
| Contig53314_RC | SEQ ID NO 2533 |
| Contig53401_RC | SEQ ID NO 2534 |
| Contig53550_RC | SEQ ID NO 2535 |
| Contig53551_RC | SEQ ID NO 2536 |
| Contig53598_RC | SEQ ID NO 2537 |
| Contig53646_RC | SEQ ID NO 2538 |
| Contig53658_RC | SEQ ID NO 2539 |
| Contig53698_RC | SEQ ID NO 2540 |
| Contig53719_RC | SEQ ID NO 2541 |
| Contig53742_RC | SEQ ID NO 2542 |
| Contig53757_RC | SEQ ID NO 2543 |
| Contig53870_RC | SEQ ID NO 2544 |
| Contig53952_RC | SEQ ID NO 2546 |
| Contig53962_RC | SEQ ID NO 2547 |
| Contig53968_RC | SEQ ID NO 2548 |
| Contig54113_RC | SEQ ID NO 2549 |
| Contig54142_RC | SEQ ID NO 2550 |
| Contig54232_RC | SEQ ID NO 2551 |
| Contig54242_RC | SEQ ID NO 2552 |
| Contig54260_RC | SEQ ID NO 2553 |
| Contig54263_RC | SEQ ID NO 2554 |
| Contig54295_RC | SEQ ID NO 2555 |
| Contig54318_RC | SEQ ID NO 2556 |
| Contig54325_RC | SEQ ID NO 2557 |
| Contig54389_RC | SEQ ID NO 2558 |
| Contig54394_RC | SEQ ID NO 2559 |
| Contig54414_RC | SEQ ID NO 2560 |
| Contig54425 | SEQ ID NO 2561 |
| Contig54477_RC | SEQ ID NO 2562 |

TABLE 1-continued 2,460 gene markers that distinguish ER(+) and ER(−) cell samples.

| GenBank Accession Number | SEQ ID NO |
|---|---|
| Contig54503_RC | SEQ ID NO 2563 |
| Contig54534_RC | SEQ ID NO 2564 |
| Contig54560_RC | SEQ ID NO 2566 |
| Contig54581_RC | SEQ ID NO 2567 |
| Contig54609_RC | SEQ ID NO 2568 |
| Contig54666_RC | SEQ ID NO 2569 |
| Contig54667_RC | SEQ ID NO 2570 |
| Contig54726_RC | SEQ ID NO 2571 |
| Contig54742_RC | SEQ ID NO 2572 |
| Contig54745_RC | SEQ ID NO 2573 |
| Contig54757_RC | SEQ ID NO 2574 |
| Contig54761_RC | SEQ ID NO 2575 |
| Contig54813_RC | SEQ ID NO 2576 |
| Contig54867_RC | SEQ ID NO 2577 |
| Contig54895_RC | SEQ ID NO 2578 |
| Contig54898_RC | SEQ ID NO 2579 |
| Contig54913_RC | SEQ ID NO 2580 |
| Contig54965_RC | SEQ ID NO 2582 |
| Contig54968_RC | SEQ ID NO 2583 |
| Contig55069_RC | SEQ ID NO 2584 |
| Contig55181_RC | SEQ ID NO 2585 |
| Contig55188_RC | SEQ ID NO 2586 |
| Contig55221_RC | SEQ ID NO 2587 |
| Contig55254_RC | SEQ ID NO 2588 |
| Contig55265_RC | SEQ ID NO 2589 |
| Contig55377_RC | SEQ ID NO 2591 |
| Contig55397_RC | SEQ ID NO 2592 |
| Contig55448_RC | SEQ ID NO 2593 |
| Contig55468_RC | SEQ ID NO 2594 |
| Contig55500_RC | SEQ ID NO 2595 |
| Contig55538_RC | SEQ ID NO 2596 |
| Contig55558_RC | SEQ ID NO 2597 |
| Contig55606_RC | SEQ ID NO 2598 |
| Contig55674_RC | SEQ ID NO 2599 |
| Contig55725_RC | SEQ ID NO 2600 |
| Contig55728_RC | SEQ ID NO 2601 |
| Contig55756_RC | SEQ ID NO 2602 |
| Contig55769_RC | SEQ ID NO 2603 |
| Contig55771_RC | SEQ ID NO 2605 |
| Contig55813_RC | SEQ ID NO 2607 |
| Contig55829_RC | SEQ ID NO 2608 |
| Contig55852_RC | SEQ ID NO 2609 |
| Contig55883_RC | SEQ ID NO 2610 |
| Contig55920_RC | SEQ ID NO 2611 |
| Contig55940_RC | SEQ ID NO 2612 |
| Contig55950_RC | SEQ ID NO 2613 |
| Contig55991_RC | SEQ ID NO 2614 |
| Contig55997_RC | SEQ ID NO 2615 |
| Contig56023_RC | SEQ ID NO 2616 |
| Contig56030_RC | SEQ ID NO 2617 |
| Contig56093_RC | SEQ ID NO 2618 |
| Contig56205_RC | SEQ ID NO 2621 |
| Contig56270_RC | SEQ ID NO 2622 |
| Contig56276_RC | SEQ ID NO 2623 |
| Contig56291_RC | SEQ ID NO 2624 |
| Contig56298_RC | SEQ ID NO 2625 |
| Contig56307 | SEQ ID NO 2627 |
| Contig56390_RC | SEQ ID NO 2628 |
| Contig56434_RC | SEQ ID NO 2629 |
| Contig56457_RC | SEQ ID NO 2630 |
| Contig56534_RC | SEQ ID NO 2631 |
| Contig56670_RC | SEQ ID NO 2632 |
| Contig56678_RC | SEQ ID NO 2633 |
| Contig56742_RC | SEQ ID NO 2634 |
| Contig56759_RC | SEQ ID NO 2635 |
| Contig56765_RC | SEQ ID NO 2636 |
| Contig56843_RC | SEQ ID NO 2637 |
| Contig57011_RC | SEQ ID NO 2638 |
| Contig57023_RC | SEQ ID NO 2639 |
| Contig57057_RC | SEQ ID NO 2640 |
| Contig57076_RC | SEQ ID NO 2641 |
| Contig57081_RC | SEQ ID NO 2642 |
| Contig57091_RC | SEQ ID NO 2643 |
| Contig57138_RC | SEQ ID NO 2644 |
| Contig57173_RC | SEQ ID NO 2645 |
| Contig57230_RC | SEQ ID NO 2646 |
| Contig57258_RC | SEQ ID NO 2647 |
| Contig57270_RC | SEQ ID NO 2648 |
| Contig57272_RC | SEQ ID NO 2649 |
| Contig57344_RC | SEQ ID NO 2650 |
| Contig57430_RC | SEQ ID NO 2651 |
| Contig57458_RC | SEQ ID NO 2652 |
| Contig57493_RC | SEQ ID NO 2653 |
| Contig57584_RC | SEQ ID NO 2654 |
| Contig57595 | SEQ ID NO 2655 |
| Contig57602_RC | SEQ ID NO 2656 |
| Contig57609_RC | SEQ ID NO 2657 |
| Contig57610_RC | SEQ ID NO 2658 |
| Contig57644_RC | SEQ ID NO 2659 |
| Contig57725_RC | SEQ ID NO 2660 |
| Contig57739_RC | SEQ ID NO 2661 |
| Contig57825_RC | SEQ ID NO 2662 |
| Contig57864_RC | SEQ ID NO 2663 |
| Contig57940_RC | SEQ ID NO 2664 |
| Contig58260_RC | SEQ ID NO 2665 |
| Contig58272_RC | SEQ ID NO 2666 |
| Contig58301_RC | SEQ ID NO 2667 |
| Contig58368_RC | SEQ ID NO 2668 |
| Contig58471_RC | SEQ ID NO 2669 |
| Contig58755_RC | SEQ ID NO 2671 |
| Contig59120_RC | SEQ ID NO 2672 |
| Contig60157_RC | SEQ ID NO 2673 |
| Contig60864_RC | SEQ ID NO 2676 |
| Contig61254_RC | SEQ ID NO 2677 |
| Contig61815 | SEQ ID NO 2678 |
| Contig61975 | SEQ ID NO 2679 |
| Contig62306 | SEQ ID NO 2680 |
| Contig62568_RC | SEQ ID NO 2681 |
| Contig62922_RC | SEQ ID NO 2682 |
| Contig62964_RC | SEQ ID NO 2683 |
| Contig63520_RC | SEQ ID NO 2685 |
| Contig63649_RC | SEQ ID NO 2686 |
| Contig63683_RC | SEQ ID NO 2687 |
| Contig63748_RC | SEQ ID NO 2688 |
| Contig64502 | SEQ ID NO 2689 |
| Contig64688 | SEQ ID NO 2690 |
| Contig64775_RC | SEQ ID NO 2691 |
| Contig65227 | SEQ ID NO 2692 |
| Contig65663 | SEQ ID NO 2693 |
| Contig65785_RC | SEQ ID NO 2694 |
| Contig65900 | SEQ ID NO 2695 |
| Contig66219_RC | SEQ ID NO 2696 |
| Contig66705_RC | SEQ ID NO 2697 |
| Contig66759_RC | SEQ ID NO 2698 |
| Contig67182_RC | SEQ ID NO 2699 |

TABLE 2

550 preferred ER status markers drawn from Table 1.

| Identifier | Correlation | Name | Description |
| --- | --- | --- | --- |
| NM_002051 | 0.763977 | GATA3 | GATA-binding protein 3 |
| AB020689 | 0.753592 | KIAA0882 | KIAA0882 protein |
| NM_001218 | 0.753225 | CA12 | carbonic anhydrase XII |
| NM_000125 | 0.748421 | ESR1 | estrogen receptor 1 |
| Contig56678_RC | 0.747816 | | ESTs |
| NM_004496 | 0.729116 | HNF3A | hepatocyte nuclear factor 3, alpha |
| NM_017732 | 0.713398 | FLJ20262 | hypothetical protein FLJ20262 |
| NM_006806 | −0.712678 | BTG3 | BTG family, member 3 |
| Contig56390_RC | 0.705940 | | ESTs |
| Contig37571_RC | 0.704468 | | ESTs |
| NM_004559 | −0.701617 | NSEP1 | nuclease sensitive element binding protein 1 |
| Contig50153_RC | −0.696652 | | ESTs, Weakly similar to LKHU proteoglycan link protein precursor [*H. sapiens*] |
| NM_012155 | 0.694332 | EMAP-2 | microtubule-associated protein like echinoderm EMAP |
| Contig237_RC | 0.687485 | FLJ21127 | hypothetical protein FLJ21127 |
| NM_019063 | −0.686064 | C2ORF2 | chromosome 2 open reading frame 2 |
| NM_012219 | −0.680900 | MRAS | muscle RAS oncogene homolog |
| NM_001982 | 0.676114 | ERBB3 | v-erb-b2 avian erythroblastic leukemia viral oncogene homolog 3 |
| NM_006623 | −0.675090 | PHGDH | phosphoglycerate dehydrogenase |
| NM_000636 | −0.674282 | SOD2 | superoxide dismutase 2, mitochondrial |
| NM_006017 | −0.670353 | PROML1 | prominin (mouse)-like 1 |
| Contig57940_RC | 0.667915 | MAP-1 | MAP-1 protein |
| Contig46934_RC | 0.666908 | | ESTs, Weakly similar to JE0350 Anterior gradient-2 [*H. sapiens*] |
| NM_005080 | 0.665772 | XBP1 | X-box binding protein 1 |
| NM_014246 | 0.665725 | CELSR1 | cadherin, EGF LAG seven-pass G-type receptor 1, flamingo (*Drosophila*) homolog |
| Contig54667_RC | −0.663727 | | Human DNA sequence from clone RP1-187J11 on chromosome 6q11.1–22.33. Contains the gene for a novel protein similar to *S. pombe* and *S. cerevisiae* predicted proteins, the gene for a novel protein similar to protein kinase C inhibitors, the 3' end of the gene for a novel protein similar to *Drosophila* L82 and predicted worm proteins, ESTs, STSs, GSSs and two putative CpG islands |
| Contig51994_RC | 0.663715 | | ESTs, Weakly similar to B0416.1 [*C. elegans*] |
| NM_016337 | 0.663006 | RNB6 | RNB6 |
| NM_015640 | −0.660165 | PAI-RBP1 | PAI-1 mRNA-binding protein |
| X07834 | −0.657798 | SOD2 | superoxide dismutase 2, mitochondrial |
| NM_012319 | 0.657666 | LIV-1 | LIV-1 protein, estrogen regulated |
| Contig41887_RC | 0.656042 | | ESTs, Weakly similar to Homolog of rat Zymogen granule membrane protein [*H. sapiens*] |
| NM_003462 | 0.655349 | P28 | dynein, axonemal, light intermediate polypeptide |
| Contig58301_RC | 0.654268 | | *Homo sapiens* mRNA; cDNA DKFZp667D095 (from clone DKFZp667D095) |
| NM_005375 | 0.653783 | MYB | v-myb avian myeloblastosis viral oncogene homolog |
| NM_017447 | −0.652445 | YG81 | hypothetical protein LOC54149 |
| Contig924_RC | −0.650658 | | ESTs |
| M55914 | −0.650181 | MPB1 | MYC promoter-binding protein 1 |
| NM_006004 | −0.649819 | UQCRH | ubiquinol-cytochrome c reductase hinge protein |
| NM_000964 | 0.649072 | RARA | retinoic acid receptor, alpha |
| NM_013301 | 0.647583 | HSU79303 | protein predicted by clone 23882 |
| AB023211 | −0.647403 | PDI2 | peptidyl arginine deiminase, type II |
| NM_016629 | −0.646412 | LOC51323 | hypothetical protein |
| K02403 | 0.645532 | C4A | complement component 4A |
| NM_016405 | −0.642201 | HSU93243 | Ubc6p homolog |
| Contig46597_RC | 0.641733 | | ESTs |
| Contig55377_RC | 0.640310 | | ESTs |

TABLE 2-continued 550 preferred ER status markers drawn from Table 1.

| Identifier | Correlation | Name | Description |
|---|---|---|---|
| NM_001207 | 0.637800 | BTF3 | basic transcription factor 3 |
| NM_018166 | 0.636422 | FLJ10647 | hypothetical protein FLJ10647 |
| AL110202 | −0.635398 | | *Homo sapiens* mRNA; cDNA DKFZp586I2022 (from clone DKFZp586I2022) |
| AL133105 | −0.635201 | DKFZp434F2322 | hypothetical protein DKFZp434F2322 |
| NM_016839 | −0.635169 | RBMS1 | RNA binding motif, single stranded interacting protein 1 |
| Contig53130 | −0.634812 | | ESTs, Weakly similar to hyperpolarization-activated cyclic nucleotide-gated channel hHCN2 [*H. sapiens*] |
| NM_018014 | −0.634460 | BCL11A | B-cell CLL/lymphoma 11A (zinc finger protein) |
| NM_006769 | −0.632197 | LMO4 | LIM domain only 4 |
| U92544 | 0.631170 | JCL-1 | hepatocellular carcinoma associated protein; breast cancer associated gene 1 |
| Contig49233_RC | −0.631047 | | *Homo sapiens*, Similar to nuclear receptor binding factor 2, clone IMAGE: 3463191, mRNA, partial cds |
| AL133033 | 0.629690 | KIAA1025 | KIAA1025 protein |
| AL049265 | 0.629414 | | *Homo sapiens* mRNA; cDNA DKFZp564F053 (from clone DKFZp564F053) |
| NM_018728 | 0.627989 | MYO5C | myosin 5C |
| NM_004780 | 0.627856 | TCEAL1 | transcription elongation factor A (SII)-like 1 |
| Contig760_RC | 0.627132 | | ESTs |
| Contig399_RC | 0.626543 | FLJ12538 | hypothetical protein FLJ12538 similar to ras-related protein RAB17 |
| M83822 | 0.625092 | CDC4L | cell division cycle 4-like |
| NM_001255 | −0.625089 | CDC20 | CDC20 (cell division cycle 20, *S. cerevisiae*, homolog) |
| NM_006739 | −0.624903 | MCM5 | minichromosome maintenance deficient (*S. cerevisiae*) 5 (cell division cycle 46) |
| NM_002888 | −0.624664 | RARRES1 | retinoic acid receptor responder (tazarotene induced) 1 |
| NM_003197 | 0.623850 | TCEB1L | transcription elongation factor B (SIII), polypeptide 1-like |
| NM_006787 | 0.623625 | JCL-1 | hepatocellular carcinoma associated protein; breast cancer associated gene 1 |
| Contig49342_RC | 0.622179 | | ESTs |
| AL133619 | 0.621719 | | *Homo sapiens* mRNA; cDNA DKFZp434E2321 (from clone DKFZp434E2321); partial cds |
| AL133622 | 0.621577 | KIAA0876 | KIAA0876 protein |
| NM_004648 | −0.621532 | PTPNS1 | protein tyrosine phosphatase, non-receptor type substrate 1 |
| NM_001793 | −0.621530 | CDH3 | cadherin 3, type 1, P-cadherin (placental) |
| NM_003217 | 0.620915 | TEGT | testis enhanced gene transcript (BAX inhibitor 1) |
| NM_001551 | 0.620832 | IGBP1 | immunoglobulin (CD79A) binding protein 1 |
| NM_002539 | −0.620683 | ODC1 | ornithine decarboxylase 1 |
| Contig55997_RC | −0.619932 | | ESTs |
| NM_000633 | 0.619547 | BCL2 | B-cell CLL/lymphoma 2 |
| NM_016267 | −0.619096 | TONDU | TONDU |
| Contig3659_RC | 0.618048 | FLJ21174 | hypothetical protein FLJ21174 |
| NM_000191 | 0.617250 | HMGCL | 3-hydroxymethyl-3-methylglutaryl-Coenzyme A lyase (hydroxymethylglutaricaciduria) |
| NM_001267 | 0.616890 | CHAD | chondroadherin |
| Contig39090_RC | 0.616385 | | ESTs |
| AF055270 | −0.616268 | HSSG1 | heat-shock suppressed protein 1 |
| Contig43054 | 0.616015 | FLJ21603 | hypothetical protein FLJ21603 |
| NM_001428 | −0.615855 | ENO1 | enolase 1, (alpha) |
| Contig51369_RC | 0.615466 | | ESTs |
| Contig36647_RC | 0.615310 | GFRA1 | GDNF family receptor alpha 1 |
| NM_014096 | −0.614832 | PRO1659 | PRO1659 protein |
| NM_015937 | 0.614735 | LOC51604 | CGI-06 protein |
| Contig49790_RC | −0.614463 | | ESTs |

TABLE 2-continued 550 preferred ER status markers drawn from Table 1.

| Identifier | Correlation | Name | Description |
| --- | --- | --- | --- |
| NM_006759 | −0.614279 | UGP2 | UDP-glucose pyrophosphorylase 2 |
| Contig53598_RC | −0.613787 | FLJ11413 | hypothetical protein FLJ11413 |
| AF113132 | −0.613561 | PSA | phosphoserine aminotransferase |
| AK000004 | 0.613001 | | *Homo sapiens* mRNA for FLJ00004 protein, partial cds |
| Contig52543_RC | 0.612960 | | *Homo sapiens* cDNA FLJ13945 fis, clone Y79AA1000969 |
| AB032966 | −0.611917 | KIAA1140 | KIAA1140 protein |
| AL080192 | 0.611544 | | *Homo sapiens* cDNA: FLJ21238 fis, clone COL01115 |
| X56807 | −0.610654 | DSC2 | desmocollin 2 |
| Contig30390_RC | 0.609614 | | ESTs |
| AL137362 | 0.609121 | FLJ22237 | hypothetical protein FLJ22237 |
| NM_014211 | −0.608585 | GABRP | gamma-aminobutyric acid (GABA) A receptor, pi |
| NM_006696 | 0.608474 | SMAP | thyroid hormone receptor coactivating protein |
| Contig45588_RC | −0.608273 | | *Homo sapiens* cDNA: FLJ22610 fis, clone HSI04930 |
| NM_003358 | 0.608244 | UGCG | UDP-glucose ceramide glucosyltransferase |
| NM_006153 | −0.608129 | NCK1 | NCK adaptor protein 1 |
| NM_001453 | −0.606939 | FOXC1 | forkhead box C1 |
| Contig54666_RC | 0.606475 | | oy65e02.x1 NCI_CGAP_CLL1 *Homo sapiens* cDNA clone IMAGE: 1670714 3' similar to TR: Q29168 Q29168 UNKNOWN PROTEIN;, mRNA sequence. |
| NM_005945 | −0.605945 | MPB1 | MYC promoter-binding protein 1 |
| Contig55725_RC | −0.605841 | | ESTs, Moderately similar to T50635 hypothetical protein DKFZp762L0311.1 [*H. sapiens*] |
| Contig37015_RC | −0.605780 | | ESTs, Weakly similar to UAS3_HUMAN UBASH3A PROTEIN [*H. sapiens*] |
| AL157480 | −0.604362 | SH3BP1 | SH3-domain binding protein 1 |
| NM_005325 | −0.604310 | H1F1 | H1 histone family, member 1 |
| NM_001446 | −0.604061 | FABP7 | fatty acid binding protein 7, brain |
| Contig263_RC | 0.603318 | | *Homo sapiens* cDNA: FLJ23000 fis, clone LNG00194 |
| Contig8347_RC | −0.603311 | | ESTs |
| NM_002988 | −0.603279 | SCYA18 | small inducible cytokine subfamily A (Cys-Cys), member 18, pulmonary and activation-regulated |
| AF111849 | 0.603157 | HELO1 | homolog of yeast long chain polyunsaturated fatty acid elongation enzyme 2 |
| NM_014700 | 0.603042 | KIAA0665 | KIAA0665 gene product |
| NM_001814 | −0.602988 | CTSC | cathepsin C |
| AF116682 | −0.602350 | PRO2013 | hypothetical protein PRO2013 |
| AB037836 | 0.602024 | KIAA1415 | KIAA1415 protein |
| AB002301 | 0.602005 | KIAA0303 | KIAA0303 protein |
| NM_002996 | −0.601841 | SCYD1 | small inducible cytokine subfamily D (Cys-X3-Cys), member 1 (fractalkine, neurotactin) |
| NM_018410 | −0.601765 | DKFZp762E1312 | hypothetical protein DKFZp762E1312 |
| Contig49581_RC | −0.601571 | KIAA1350 | KIAA1350 protein |
| NM_003088 | −0.601458 | SNL | singed (*Drosophila*)-like (sea urchin fascin homolog like) |
| Contig47045_RC | 0.601088 | | ESTs, Weakly similar to DP1_HUMAN POLYPOSIS LOCUS PROTEIN 1 [*H. sapiens*] |
| NM_001806 | −0.600954 | CEBPG | CCAAT/enhancer binding protein (C/EBP), gamma |
| NM_004374 | 0.600766 | COX6C | cytochrome c oxidase subunit VIc |
| Contig52641_RC | 0.600132 | | ESTs, Weakly similar to CENB MOUSE MAJOR CENTROMERE AUTOANTIGEN B [*M. musculus*] |
| NM_000100 | −0.600127 | CSTB | cystatin B (stefin B) |
| NM_002250 | −0.600004 | KCNN4 | potassium intermediate/small conductance calcium-activated channel, subfamily N, member 4 |
| AB033035 | −0.599423 | KIAA1209 | KIAA1209 protein |
| Contig53968_RC | 0.599077 | | ESTs |

TABLE 2-continued 550 preferred ER status markers drawn from Table 1.

| Identifier | Correlation | Name | Description |
|---|---|---|---|
| NM_002300 | −0.598246 | LDHB | lactate dehydrogenase B |
| NM_000507 | 0.598110 | FBP1 | fructose-1,6-bisphosphatase 1 |
| NM_002053 | −0.597756 | GBP1 | guanylate binding protein 1, interferon-inducible, 67 kD |
| AB007883 | 0.597043 | KIAA0423 | KIAA0423 protein |
| NM_004900 | −0.597010 | DJ742C19.2 | phorbolin (similar to apolipoprotein B mRNA editing protein) |
| NM_004480 | 0.596321 | FUT8 | fucosyltransferase 8 (alpha (1,6) fucosyltransferase) |
| Contig35896_RC | 0.596281 | | ESTs |
| NM_020974 | 0.595173 | CEGP1 | CEGP1 protein |
| NM_000662 | 0.595114 | NAT1 | N-acetyltransferase 1 (arylamine N-acetyltransferase) |
| NM_006113 | 0.595017 | VAV3 | vav 3 oncogene |
| NM_014865 | −0.594928 | KIAA0159 | chromosome condensation-related SMC-associated protein 1 |
| Contig55538_RC | −0.594573 | BA395L14.2 | hypothetical protein bA395L14.2 |
| NM_016056 | 0.594084 | LOC51643 | CGI-119 protein |
| NM_003579 | −0.594063 | RAD54L | RAD54 (S. cerevisiae)-like |
| NM_014214 | −0.593860 | IMPA2 | inositol(myo)-1(or 4)-monophosphatase 2 |
| U79293 | 0.593793 | | Human clone 23948 mRNA sequence |
| NM_005557 | −0.593746 | KRT16 | keratin 16 (focal non-epidermolytic palmoplantar keratoderma) |
| NM_002444 | −0.592405 | MSN | moesin |
| NM_003681 | −0.592155 | PDXK | pyridoxal (pyridoxine, vitamin B6) kinase |
| NM_006372 | −0.591711 | NSAP1 | NS1-associated protein 1 |
| NM_005218 | −0.591192 | DEFB1 | defensin, beta 1 |
| NM_004642 | −0.591081 | DOC1 | deleted in oral cancer (mouse, homolog) 1 |
| AL133074 | 0.590359 | | Homo sapiens cDNA: FLJ22139 fis, clone HEP20959 |
| M73547 | 0.590317 | D5S346 | DNA segment, single copy probe LNS-CAI/LNS-CAII (deleted in polyposis) |
| Contig65663 | 0.590312 | | ESTs |
| AL035297 | −0.589728 | | H. sapiens gene from PAC 747L4 |
| Contig35629_RC | 0.589383 | | ESTs |
| NM_019027 | 0.588862 | FLJ20273 | hypothetical protein |
| NM_012425 | −0.588804 | | Homo sapiens Ras suppressor protein 1 (RSU1), mRNA |
| NM_020179 | −0.588326 | FN5 | FN5 protein |
| AF090913 | −0.587275 | TMSB10 | thymosin, beta 10 |
| NM_004176 | 0.587190 | SREBF1 | sterol regulatory element binding transcription factor 1 |
| NM_016121 | 0.586941 | LOC51133 | NY-REN-45 antigen |
| NM_014773 | 0.586871 | KIAA0141 | KIAA0141 gene product |
| NM_019000 | 0.586677 | FLJ20152 | hypothetical protein |
| NM_016243 | 0.585942 | LOC51706 | cytochrome b5 reductase 1 (B5R.1) |
| NM_014274 | −0.585815 | ABP/ZF | Alu-binding protein with zinc finger domain |
| NM_018379 | 0.585497 | FLJ11280 | hypothetical protein FLJ11280 |
| AL157431 | −0.585077 | DKFZp762A227 | hypothetical protein DKFZp762A227 |
| D38521 | −0.584684 | KIAA0077 | KIAA0077 protein |
| NM_002570 | 0.584272 | PACE4 | paired basic amino acid cleaving system 4 |
| NM_001809 | −0.584252 | CENPA | centromere protein A (17 kD) |
| NM_003318 | −0.583556 | TTK | TTK protein kinase |
| NM_014325 | −0.583555 | CORO1C | coronin, actin-binding protein, 1C |
| NM_005667 | 0.583376 | ZFP103 | zinc finger protein homologous to Zfp103 in mouse |
| NM_004354 | 0.582420 | CCNG2 | cyclin G2 |
| NM_003670 | 0.582235 | BHLHB2 | basic helix-loop-helix domain containing, class B, 2 |
| NM_001673 | −0.581902 | ASNS | asparagine synthetase |
| NM_001333 | −0.581402 | CTSL2 | cathepsin L2 |
| Contig54295_RC | 0.581256 | | ESTs |
| Contig33998_RC | 0.581018 | | ESTs |
| NM_006002 | −0.580592 | UCHL3 | ubiquitin carboxyl-terminal esterase L3 (ubiquitin thiolesterase) |
| NM_015392 | 0.580568 | NPDC1 | neural proliferation, differentiation and control, 1 |
| NM_004866 | 0.580138 | SCAMP1 | secretory carrier membrane protein 1 |

TABLE 2-continued 550 preferred ER status markers drawn from Table 1.

| Identifier | Correlation | Name | Description |
| --- | --- | --- | --- |
| Contig50391_RC | 0.580071 | | ESTs |
| NM_000592 | 0.579965 | C4B | complement component 4B |
| Contig50802_RC | 0.579881 | | ESTs |
| Contig41635_RC | −0.579468 | | ESTs |
| NM_006845 | −0.579339 | KNSL6 | kinesin-like 6 (mitotic centromere-associated kinesin) |
| NM_003720 | −0.579296 | DSCR2 | Down syndrome critical region gene 2 |
| NM_000060 | 0.578967 | BTD | biotinidase |
| AL050388 | −0.578736 | | *Homo sapiens* mRNA; cDNA DKFZp564M2422 (from clone DKFZp564M2422); partial cds |
| NM_003772 | −0.578395 | JRKL | jerky (mouse) homolog-like |
| NM_014398 | −0.578388 | TSC403 | similar to lysosome-associated membrane glycoprotein |
| NM_001280 | 0.578213 | CIRBP | cold inducible RNA-binding protein |
| NM_001395 | −0.577369 | DUSP9 | dual specificity phosphatase 9 |
| NM_016229 | −0.576290 | LOC51700 | cytochrome b5 reductase b5R.2 |
| NM_006096 | −0.575615 | NDRG1 | N-myc downstream regulated |
| NM_001552 | 0.575438 | IGFBP4 | insulin-like growth factor-binding protein 4 |
| NM_005558 | −0.574818 | LAD1 | ladinin 1 |
| Contig54534_RC | 0.574784 | | Human glucose transporter pseudogene |
| Contig1239_RC | 0.573822 | | Human Chromosome 16 BAC clone CIT987SK-A-362G6 |
| Contig57173_RC | 0.573807 | | *Homo sapiens* mRNA for KIAA1737 protein, partial cds |
| NM_004414 | −0.573538 | DSCR1 | Down syndrome critical region gene 1 |
| NM_021103 | −0.572722 | TMSB10 | thymosin, beta 10 |
| NM_002350 | −0.571917 | LYN | v-yes-1 Yamaguchi sarcoma viral related oncogene homolog |
| Contig51235_RC | 0.571049 | | *Homo sapiens* cDNA: FLJ23388 fis, clone HEP17008 |
| NM_013384 | 0.570987 | TMSG1 | tumor metastasis-suppressor |
| NM_014399 | 0.570936 | NET-6 | tetraspan NET-6 protein |
| Contig26022_RC | −0.570851 | | ESTs |
| AB023152 | 0.570561 | KIAA0935 | KIAA0935 protein |
| NM_021077 | −0.569944 | NMB | neuromedin B |
| NM_003498 | −0.569129 | SNN | stannin |
| U17077 | −0.568979 | BENE | BENE protein |
| D86985 | 0.567698 | KIAA0232 | KIAA0232 gene product |
| NM_006357 | −0.567513 | UBE2E3 | ubiquitin-conjugating enzyme E2E 3 (homologous to yeast UBC4/5) |
| AL049397 | −0.567434 | | *Homo sapiens* mRNA; cDNA DKFZp586C1019 (from clone DKFZp586C1019) |
| Contig64502 | 0.567433 | | ESTs, Weakly similar to unknown [*M. musculus*] |
| Contig56298_RC | −0.566892 | FLJ13154 | hypothetical protein FLJ13154 |
| Contig46056_RC | 0.566634 | | ESTs, Weakly similar to YZ28_HUMAN HYPOTHETICAL PROTEIN ZAP128 [*H. sapiens*] |
| AF007153 | 0.566044 | | *Homo sapiens* clone 23736 mRNA sequence |
| Contig1778_RC | −0.565789 | | ESTs |
| NM_017702 | −0.565789 | FLJ20186 | hypothetical protein FLJ20186 |
| Contig39226_RC | 0.565761 | | *Homo sapiens* cDNA FLJ12187 fis, clone MAMMA1000831 |
| NM_000168 | 0.564879 | GLI3 | GLI-Kruppel family member GLI3 (Greig cephalopolysyndactyly syndrome) |
| Contig57609_RC | 0.564751 | | ESTs, Weakly similar to T2D3_HUMAN TRANSCRIPTION INITIATION FACTOR TFIID 135 KDA SUBUNIT [*H. sapiens*] |
| U45975 | 0.564602 | PIB5PA | phosphatidylinositol (4,5) bisphosphate 5-phosphatase, A |
| AF038182 | 0.564596 | | *Homo sapiens* clone 23860 mRNA sequence |
| Contig5348_RC | 0.564480 | | ESTs, Weakly similar to 1607338A transcription factor BTF3a [*H. sapiens*] |
| NM_001321 | −0.564459 | CSRP2 | cysteine and glycine-rich protein 2 |
| Contig25362_RC | −0.563801 | | ESTs |

TABLE 2-continued 550 preferred ER status markers drawn from Table 1.

| Identifier | Correlation | Name | Description |
| --- | --- | --- | --- |
| NM_001609 | 0.563782 | ACADSB | acyl-Coenzyme A dehydrogenase, short/branched chain |
| Contig40146 | 0.563731 | | wi84e12.x1 NCI_CGAP_Kid12 *Homo sapiens* cDNA clone IMAGE: 2400046 3' similar to SW: RASD_DICDI P03967 RAS-LIKE PROTEIN RASD;, mRNA sequence. |
| NM_016002 | 0.563403 | LOC51097 | CGI-49 protein |
| Contig34303_RC | 0.563157 | | *Homo sapiens* cDNA: FLJ21517 fis, clone COL05829 |
| Contig55883_RC | 0.563141 | | ESTs |
| NM_017961 | 0.562479 | FLJ20813 | hypothetical protein FLJ20813 |
| M21551 | −0.562340 | NMB | neuromedin B |
| Contig3940_RC | −0.561956 | YWHAH | tyrosine 3-monooxygenase/tryptophan 5-monooxygenase activation protein, eta polypeptide |
| AB033111 | −0.561746 | KIAA1285 | KIAA1285 protein |
| Contig43410_RC | 0.561678 | | ESTs |
| Contig42006_RC | −0.561677 | | ESTs |
| Contig57272_RC | 0.561228 | | ESTs |
| G26403 | −0.561068 | YWHAH | tyrosine 3-monooxygenase/tryptophan 5-monooxygenase activation protein, eta polypeptide |
| NM_005915 | −0.560813 | MCM6 | minichromosome maintenance deficient (mis5, *S. pombe*) 6 |
| NM_003875 | −0.560668 | GMPS | guanine monphosphate synthetase |
| AK000142 | 0.559651 | AK000142 | *Homo sapiens* cDNA FLJ20135 fis, clone COL06818. |
| NM_002709 | −0.559621 | PPP1CB | protein phosphatase 1, catalytic subunit, beta isoform |
| NM_001276 | −0.558868 | CHI3L1 | chitinase 3-like 1 (cartilage glycoprotein-39) |
| NM_002857 | 0.558862 | PXF | peroxisomal farnesylated protein |
| Contig33815_RC | −0.558741 | FLJ22833 | hypothetical protein FLJ22833 |
| NM_003740 | −0.558491 | KCNK5 | potassium channel, subfamily K, member 5 (TASK-2) |
| Contig53646_RC | 0.558455 | | ESTs |
| NM_005538 | −0.558350 | INHBC | inhibin, beta C |
| NM_002111 | 0.557860 | HD | huntingtin (Huntington disease) |
| NM_003683 | −0.557807 | D21S2056E | DNA segment on chromosome 21 (unique) 2056 expressed sequence |
| NM_003035 | −0.557380 | SIL | TAL1 (SCL) interrupting locus |
| Contig4388_RC | −0.557216 | | *Homo sapiens*, Similar to integral membrane protein 3, clone MGC: 3011, mRNA, complete cds |
| Contig38288_RC | −0.556426 | | ESTs, Weakly similar to ISHUSS protein disulfide-isomerase [*H. sapiens*] |
| NM_015417 | 0.556184 | DKFZP434I114 | DKFZP434I114 protein |
| NM_015507 | −0.556138 | EGFL6 | EGF-like-domain, multiple 6 |
| AF279865 | 0.555951 | KIF13B | kinesin family member 13B |
| Contig31288_RC | −0.555754 | | ESTs |
| NM_002966 | −0.555620 | S100A10 | S100 calcium-binding protein A10 (annexin II ligand, calpactin I, light polypeptide (p11)) |
| NM_017585 | −0.555476 | SLC2A6 | solute carrier family 2 (facilitated glucose transporter), member 6 |
| NM_013296 | −0.555367 | HSU54999 | LGN protein |
| NM_000224 | 0.554838 | KRT18 | keratin 18 |
| Contig49270_RC | −0.554593 | KIAA1553 | KIAA1553 protein |
| NM_004848 | −0.554538 | ICB-1 | basement membrane-induced gene |
| NM_007275 | 0.554278 | FUS1 | lung cancer candidate |
| NM_007044 | −0.553550 | KATNA1 | katanin p60 (ATPase-containing) subunit A 1 |
| Contig1829 | 0.553317 | | ESTs |
| AF272357 | 0.553286 | NPDC1 | neural proliferation, differentiation and control, 1 |
| Contig57584_RC | −0.553080 | | *Homo sapiens*, Similar to gene rich cluster, C8 gene, clone MGC: 2577, mRNA, complete cds |
| NM_003039 | −0.552747 | SLC2A5 | solute carrier family 2 (facilitated glucose transporter), member 5 |

TABLE 2-continued 550 preferred ER status markers drawn from Table 1.

| Identifier | Correlation | Name | Description |
|---|---|---|---|
| NM_014216 | 0.552321 | ITPK1 | inositol 1,3,4-triphosphate 5/6 kinase |
| NM_007027 | −0.552064 | TOPBP1 | topoisomerase (DNA) II binding protein |
| AF118224 | −0.551916 | ST14 | suppression of tumorigenicity 14 (colon carcinoma, matriptase, epithin) |
| X75315 | −0.551853 | HSRNASEB | seb4D |
| NM_012101 | −0.551824 | ATDC | ataxia-telangiectasia group D-associated protein |
| AL157482 | −0.551329 | FLJ23399 | hypothetical protein FLJ23399 |
| NM_012474 | −0.551150 | UMPK | uridine monophosphate kinase |
| Contig57081_RC | 0.551103 | | ESTs |
| NM_006941 | −0.551069 | SOX10 | SRY (sex determining region Y)-box 10 |
| NM_004694 | 0.550932 | SLC16A6 | solute carrier family 16 (monocarboxylic acid transporters), member 6 |
| Contig9541_RC | 0.550680 | | ESTs |
| Contig20617_RC | 0.550546 | | ESTs |
| NM_004252 | 0.550365 | SLC9A3R1 | solute carrier family 9 (sodium/hydrogen exchanger), isoform 3 regulatory factor 1 |
| NM_015641 | −0.550200 | DKFZP586B2022 | testin |
| NM_004336 | −0.550164 | BUB1 | budding uninhibited by benzimidazoles 1 (yeast homolog) |
| Contig39960_RC | −0.549951 | FLJ21079 | hypothetical protein FLJ21079 |
| NM_020686 | 0.549659 | NPD009 | NPD009 protein |
| NM_002633 | −0.549647 | PGM1 | phosphoglucomutase 1 |
| Contig30480_RC | 0.548932 | | ESTs |
| NM_003479 | 0.548896 | PTP4A2 | protein tyrosine phosphatase type IVA, member 2 |
| NM_001679 | −0.548768 | ATP1B3 | ATPase, Na+/K+ transporting, beta 3 polypeptide |
| NM_001124 | −0.548601 | ADM | adrenomedullin |
| NM_001216 | −0.548375 | CA9 | carbonic anhydrase IX |
| U58033 | −0.548354 | MTMR2 | myotubularin related protein 2 |
| NM_018389 | −0.547875 | FLJ11320 | hypothetical protein FLJ11320 |
| AF176012 | 0.547867 | JDP1 | J domain containing protein 1 |
| Contig66705_RC | −0.546926 | ST5 | suppression of tumorigenicity 5 |
| NM_018194 | 0.546878 | FLJ10724 | hypothetical protein FLJ10724 |
| NM_006851 | −0.546823 | RTVP1 | glioma pathogenesis-related protein |
| Contig53870_RC | 0.546756 | | ESTs |
| NM_002482 | −0.546012 | NASP | nuclear autoantigenic sperm protein (histone-binding) |
| NM_002292 | 0.545949 | LAMB2 | laminin, beta 2 (laminin S) |
| NM_014696 | −0.545758 | KIAA0514 | KIAA0514 gene product |
| Contig49855 | 0.545517 | | ESTs |
| AL117666 | 0.545203 | DKFZP586O1624 | DKFZP586O1624 protein |
| NM_004701 | −0.545185 | CCNB2 | cyclin B2 |
| NM_007050 | 0.544890 | PTPRT | protein tyrosine phosphatase, receptor type, T |
| NM_000414 | 0.544778 | HSD17B4 | hydroxysteroid (17-beta) dehydrogenase 4 |
| Contig52398_RC | −0.544775 | | *Homo sapiens* cDNA: FLJ21950 fis, clone HEP04949 |
| AB007916 | 0.544496 | KIAA0447 | KIAA0447 gene product |
| Contig66219_RC | 0.544467 | FLJ22402 | hypothetical protein FLJ22402 |
| D87453 | 0.544145 | KIAA0264 | KIAA0264 protein |
| NM_015515 | −0.543929 | DKFZP434G032 | DKFZP434G032 protein |
| NM_001530 | −0.543898 | HIF1A | hypoxia-inducible factor 1, alpha subunit (basic helix-loop-helix transcription factor) |
| NM_004109 | −0.543893 | FDX1 | ferredoxin 1 |
| NM_000381 | −0.543871 | MID1 | midline 1 (Opitz/BBB syndrome) |
| Contig43983_RC | 0.543523 | CS2 | calsyntenin-2 |
| AL137761 | 0.543371 | | *Homo sapiens* mRNA; cDNA DKFZp586L2424 (from clone DKFZp586L2424) |
| NM_005764 | −0.543175 | DD96 | epithelial protein up-regulated in carcinoma, membrane associated protein 17 |
| Contig1838_RC | 0.542996 | | *Homo sapiens* cDNA: FLJ22722 fis, clone HSI14444 |

TABLE 2-continued 550 preferred ER status markers drawn from Table 1.

| Identifier | Correlation | Name | Description |
|---|---|---|---|
| NM_006670 | 0.542932 | 5T4 | 5T4 oncofetal trophoblast glycoprotein |
| Contig28552_RC | −0.542617 | | Homo sapiens mRNA; cDNA DKFZp434C0931 (from clone DKFZp434C0931); partial cds |
| Contig14284_RC | 0.542224 | | ESTs |
| NM_006290 | −0.542115 | TNFAIP3 | tumor necrosis factor, alpha-induced protein 3 |
| AL050372 | 0.541463 | | Homo sapiens mRNA; cDNA DKFZp434A091 (from clone DKFZp434A091); partial cds |
| NM_014181 | −0.541095 | HSPC159 | HSPC159 protein |
| Contig37141_RC | 0.540990 | | Homo sapiens cDNA: FLJ23582 fis, clone LNG 13759 |
| NM_000947 | −0.540621 | PRIM2A | primase, polypeptide 2A (58 kD) |
| NM_002136 | 0.540572 | HNRPA1 | heterogeneous nuclear ribonucleoprotein A1 |
| NM_004494 | −0.540543 | HDGF | hepatoma-derived growth factor (high-mobility group protein 1-like) |
| Contig38983_RC | 0.540526 | | ESTs |
| Contig27882_RC | −0.540506 | | ESTs |
| Z11887 | −0.540020 | MMP7 | matrix metalloproteinase 7 (matrilysin, uterine) |
| NM_014575 | −0.539725 | SCHIP-1 | schwannomin interacting protein 1 |
| Contig38170_RC | 0.539708 | | ESTs |
| Contig44064_RC | 0.539403 | | ESTs |
| U68385 | 0.539395 | MEIS3 | Meis (mouse) homolog 3 |
| Contig51967_RC | 0.538952 | | ESTs |
| Contig37562_RC | 0.538657 | | ESTs, Weakly similar to transformation-related protein [H. sapiens] |
| Contig40500_RC | 0.538582 | | ESTs, Weakly similar to unnamed protein product [H. sapiens] |
| Contig1129_RC | 0.538339 | | ESTs |
| NM_002184 | 0.538185 | IL6ST | interleukin 6 signal transducer (gp130, oncostatin M receptor) |
| AL049381 | 0.538041 | | Homo sapiens cDNA FLJ12900 fis, clone NT2RP2004321 |
| NM_002189 | −0.537867 | IL15RA | interleukin 15 receptor, alpha |
| NM_012110 | −0.537562 | CHIC2 | cystein-rich hydrophobic domain 2 |
| AB040881 | −0.537473 | KIAA1448 | KIAA1448 protein |
| NM_016577 | −0.537430 | RAB6B | RAB6B, member RAS oncogene family |
| NM_001745 | 0.536940 | CAMLG | calcium modulating ligand |
| NM_005742 | −0.536738 | P5 | protein disulfide isomerase-related protein |
| AB011132 | 0.536345 | KIAA0560 | KIAA0560 gene product |
| Contig54898_RC | 0.536094 | PNN | pinin, desmosome associated protein |
| Contig45049_RC | −0.536043 | FUT4 | fucosyltransferase 4 (alpha (1,3) fucosyltransferase, myeloid-specific) |
| NM_006864 | −0.535924 | LILRB3 | leukocyte immunoglobulin-like receptor, subfamily B (with TM and ITIM domains), member 3 |
| Contig53242_RC | −0.535909 | | Homo sapiens cDNA FLJ11436 fis, clone HEMBA1001213 |
| NM_005544 | 0.535712 | IRS1 | insulin receptor substrate 1 |
| Contig47456_RC | 0.535493 | CACNA1D | calcium channel, voltage-dependent, L type, alpha 1D subunit |
| Contig42751_RC | −0.535469 | | ESTs |
| Contig29126_RC | −0.535186 | | ESTs |
| NM_012391 | 0.535067 | PDEF | prostate epithelium-specific Ets transcription factor |
| NM_012429 | 0.534974 | SEC14L2 | SEC14 (S. cerevisiae)-like 2 |
| NM_018171 | 0.534898 | FLJ10659 | hypothetical protein FLJ10659 |
| Contig53047_RC | −0.534773 | TTYH1 | tweety (Drosophila) homolog 1 |
| Contig54968_RC | 0.534754 | | Homo sapiens cDNA FLJ13558 fis, clone PLACE1007743 |
| Contig2099_RC | −0.534694 | KIAA1691 | KIAA1691 protein |
| NM_005264 | 0.534057 | GFRA1 | GDNF family receptor alpha 1 |
| NM_014036 | −0.533638 | SBBI42 | BCM-like membrane protein precursor |
| NM_018101 | −0.533473 | FLJ10468 | hypothetical protein FLJ10468 |
| Contig56765_RC | 0.533442 | | ESTs, Moderately similar to K02E10.2 [C. elegans] |

TABLE 2-continued 550 preferred ER status markers drawn from Table 1.

| Identifier | Correlation | Name | Description |
|---|---|---|---|
| AB006746 | −0.533400 | PLSCR1 | phospholipid scramblase 1 |
| NM_001089 | 0.533350 | ABCA3 | ATP-binding cassette, sub-family A (ABC1), member 3 |
| NM_018188 | −0.533132 | FJ10709 | hypothetical protein FLJ10709 |
| X94232 | −0.532925 | MAPRE2 | microtubule-associated protein, RP/EB family, member 2 |
| AF234532 | −0.532910 | MYO10 | myosin X |
| Contig292_RC | 0.532853 | FLJ22386 | hypothetical protein FLJ22386 |
| NM_000101 | −0.532767 | CYBA | cytochrome b-245, alpha polypeptide |
| Contig47814_RC | −0.532656 | HHGP | HHGP protein |
| NM_014320 | −0.532430 | SOUL | putative heme-binding protein |
| NM_020347 | 0.531976 | LZTFL1 | leucine zipper transcription factor-like 1 |
| NM_004323 | 0.531936 | BAG1 | BCL2-associated athanogene |
| Contig50850_RC | −0.531914 | | ESTs |
| Contig11648_RC | 0.531704 | | ESTs |
| NM_018131 | −0.531559 | FLJ10540 | hypothetical protein FLJ10540 |
| NM_004688 | −0.531329 | NMI | N-myc (and STAT) interactor |
| NM_014870 | 0.531101 | KIAA0478 | KIAA0478 gene product |
| Contig31424_RC | 0.530720 | | ESTs |
| NM_000874 | −0.530545 | IFNAR2 | interferon (alpha, beta and omega) receptor 2 |
| Contig50588_RC | 0.530145 | | ESTs |
| NM_016463 | 0.529998 | HSPC195 | hypothetical protein |
| NM_013324 | 0.529966 | CISH | cytokine inducible SH2-containing protein |
| NM_006705 | 0.529840 | GADD45G | growth arrest and DNA-damage-inducible, gamma |
| Contig38901_RC | −0.529747 | | ESTs |
| NM_004184 | −0.529635 | WARS | tryptophanyl-tRNA synthetase |
| NM_015955 | −0.529538 | LOC51072 | CGI-27 protein |
| AF151810 | 0.529416 | CGI-52 | similar to phosphatidylcholine transfer protein 2 |
| NM_002164 | −0.529117 | INDO | indoleamine-pyrrole 2,3 dioxygenase |
| NM_004267 | −0.528679 | CHST2 | carbohydrate (chondroitin 6/keratan) sulfotransferase 2 |
| Contig32185_RC | −0.528529 | | Homo sapiens cDNA FLJ13997 fis, clone Y79AA1002220 |
| NM_004154 | −0.528343 | P2RY6 | pyrimidinergic receptor P2Y, G-protein coupled, 6 |
| NM_005235 | 0.528294 | ERBB4 | v-erb-a avian erythroblastic leukemia viral oncogene homolog-like 4 |
| Contig40208_RC | −0.528062 | LOC56938 | transcription factor BMAL2 |
| NM_013262 | 0.527297 | MIR | myosin regulatory light chain interacting protein |
| NM_003034 | −0.527148 | SIAT8A | sialyltransferase 8 (alpha-N-acetylneuraminate: alpha-2,8-sialytransferase, GD3 synthase) A |
| NM_004556 | −0.527146 | NFKBIE | nuclear factor of kappa light polypeptide gene enhancer in B-cells inhibitor, epsilon |
| NM_002046 | −0.527051 | GAPD | glyceraldehyde-3-phosphate dehydrogenase |
| NM_001905 | −0.526986 | CTPS | CTP synthase |
| Contig42402_RC | 0.526852 | | ESTs |
| NM_014272 | −0.526283 | ADAMTS7 | a disintegrin-like and metalloprotease (reprolysin type) with thrombospondin type 1 motif, 7 |
| AF076612 | 0.526205 | CHRD | chordin |
| Contig57725_RC | −0.526122 | | Homo sapiens mRNA for HMG-box transcription factor TCF-3, complete cds |
| Contig42041_RC | −0.525877 | | ESTs |
| Contig44656_RC | −0.525868 | | ESTs, Highly similar to S02392 alpha-2-macroglobulin receptor precursor [H. sapiens] |
| NM_018004 | −0.525610 | FLJ10134 | hypothetical protein FLJ10134 |
| Contig56434_RC | 0.525510 | | Homo sapiens cDNA FLJ13603 fis, clone PLACE 1010270 |
| D25328 | −0.525504 | PFKP | phosphofructokinase, platelet |
| Contig55950_RC | −0.525358 | FLJ22329 | hypothetical protein FLJ22329 |
| NM_002648 | −0.525211 | PIM1 | pim-1 oncogene |

TABLE 2-continued 550 preferred ER status markers drawn from Table 1.

| Identifier | Correlation | Name | Description |
| --- | --- | --- | --- |
| AL157505 | 0.525186 | | Homo sapiens mRNA; cDNA DKFZp586P1124 (from clone DKFZp586P1124) |
| AF061034 | −0.525185 | FIP2 | Homo sapiens FIP2 alternatively translated mRNA, complete cds. |
| NM_014721 | −0.525102 | KIAA0680 | KIAA0680 gene product |
| NM_001634 | −0.525030 | AMD1 | S-adenosylmethionine decarboxylase 1 |
| NM_006304 | −0.524911 | DSS1 | Deleted in split-hand/split-foot 1 region |
| Contig37778_RC | 0.524667 | | ESTs, Highly similar to HLHUSB MHC class II histocompatibility antigen HLA-DP alpha-1 chain precursor [H. sapiens] |
| NM_003099 | 0.524339 | SNX1 | sorting nexin 1 |
| AL079298 | 0.523774 | MCCC2 | methylcrotonoyl-Coenzyme A carboxylase 2 (beta) |
| NM_019013 | −0.523663 | FLJ10156 | hypothetical protein |
| NM_000397 | −0.523293 | CYBB | cytochrome b-245, beta polypeptide (chronic granulomatous disease) |
| NM_014811 | 0.523132 | KIAA0649 | KIAA0649 gene product |
| Contig20600_RC | 0.523072 | | ESTs |
| NM_005190 | −0.522710 | CCNC | cyclin C |
| AL161960 | −0.522574 | FLJ21324 | hypothetical protein FLJ21324 |
| AL117502 | 0.522280 | | Homo sapiens mRNA; cDNA DKFZp434D0935 (from clone DKFZp434D0935) |
| AF131753 | −0.522245 | | Homo sapiens clone 24859 mRNA sequence |
| NM_000320 | 0.521974 | QDPR | quinoid dihydropteridine reductase |
| NM_002115 | −0.521870 | HK3 | hexokinase 3 (white cell) |
| NM_006460 | 0.521696 | HIS1 | HMBA-inducible |
| NM_018683 | −0.521679 | ZNF313 | zinc finger protein 313 |
| NM_004305 | −0.521539 | BIN1 | bridging integrator 1 |
| NM_006770 | −0.521538 | MARCO | macrophage receptor with collagenous structure |
| NM_001166 | −0.521530 | BIRC2 | baculoviral IAP repeat-containing 2 |
| D42047 | 0.521522 | KIAA0089 | KIAA0089 protein |
| NM_016235 | −0.521298 | GPRC5B | G protein-coupled receptor, family C, group 5, member B |
| NM_004504 | −0.521189 | HRB | HIV-1 Rev binding protein |
| NM_002727 | −0.521146 | PRG1 | proteoglycan 1, secretory granule |
| AB029031 | −0.520761 | KIAA1108 | KIAA1108 protein |
| NM_005556 | −0.520692 | KRT7 | keratin 7 |
| NM_018031 | 0.520600 | WDR6 | WD repeat domain 6 |
| AL117523 | −0.520579 | KIAA1053 | KIAA1053 protein |
| NM_004515 | −0.520363 | ILF2 | interleukin enhancer binding factor 2, 45 kD |
| NM_004708 | −0.519935 | PDCD5 | programmed cell death 5 |
| NM_005935 | 0.519765 | MLLT2 | myeloid/lymphoid or mixed-lineage leukemia (trithorax (Drosophila) homolog); translocated to, 2 |
| Contig49289_RC | −0.519546 | | Homo sapiens mRNA; cDNA DKFZp586J1119 (from clone DKFZp586J1119); complete cds |
| NM_000211 | −0.519342 | ITGB2 | integrin, beta 2 (antigen CD18 (p95), lymphocyte function-associated antigen 1; macrophage antigen 1 (mac-1) beta subunit) |
| AL079276 | 0.519207 | LOC58495 | putative zinc finger protein from EUROIMAGE 566589 |
| Contig57825_RC | 0.519041 | | ESTs |
| NM_002466 | −0.518911 | MYBL2 | v-myb avian myeloblastosis viral oncogene homolog-like 2 |
| NM_016072 | −0.518802 | LOC51026 | CGI-141 protein |
| AB007950 | −0.518699 | KIAA0481 | KIAA0481 gene product |
| NM_001550 | −0.518549 | IFRD1 | interferon-related developmental regulator 1 |
| AF155120 | −0.518221 | UBE2V1 | ubiquitin-conjugating enzyme E2 variant 1 |
| Contig49849_RC | 0.517983 | | ESTs, Weakly similar to AF188706 1 g20 protein [H. sapiens] |
| NM_016625 | −0.517936 | LOC51319 | hypothetical protein |
| NM_004049 | −0.517862 | BCL2A1 | BCL2-related protein A1 |
| Contig50719_RC | 0.517740 | | ESTs |

TABLE 2-continued 550 preferred ER status markers drawn from Table 1.

| Identifier | Correlation | Name | Description |
| --- | --- | --- | --- |
| D80010 | −0.517620 | LPIN1 | lipin 1 |
| NM_000299 | −0.517405 | PKP1 | plakophilin 1 (ectodermal dysplasia/skin fragility syndrome) |
| AL049365 | 0.517080 | FTL | ferritin, light polypeptide |
| Contig65227 | 0.517003 | | ESTs |
| NM_004865 | −0.516808 | TBPL1 | TBP-like 1 |
| Contig54813_RC | 0.516246 | FLJ13962 | hypothetical protein FLJ13962 |
| NM_003494 | −0.516221 | DYSF | dysferlin, limb girdle muscular dystrophy 2B (autosomal recessive) |
| NM_004431 | −0.516212 | EPHA2 | EphA2 |
| AL117600 | −0.516067 | DKFZP564J0863 | DKFZP564J0863 protein |
| AL080209 | −0.516037 | DKFZP586F2423 | hypothetical protein DKFZp586F2423 |
| NM_000135 | −0.515613 | FANCA | Fanconi anemia, complementation group A |
| NM_000050 | −0.515494 | ASS | argininosuccinate synthetase |
| NM_001830 | −0.515439 | CLCN4 | chloride channel 4 |
| NM_018234 | −0.515365 | FLJ10829 | hypothetical protein FLJ10829 |
| Contig53307_RC | 0.515328 | | ESTs, Highly similar to KIAA1437 protein [*H. sapiens*] |
| AL117617 | −0.515141 | | *Homo sapiens* mRNA; cDNA DKFZp564H0764 (from clone DKFZp564H0764) |
| NM_002906 | −0.515098 | RDX | radixin |
| NM_003360 | −0.514427 | UGT8 | UDP glycosyltransferase 8 (UDP-galactose ceramide galactosyltransferase) |
| NM_018478 | 0.514332 | HSMNP1 | uncharacterized hypothalamus protein HSMNP1 |
| M90657 | −0.513908 | TM4SF1 | transmembrane 4 superfamily member 1 |
| NM_014967 | 0.513793 | KIAA1018 | KIAA1018 protein |
| Contig1462_RC | 0.513604 | C11ORF15 | chromosome 11 open reading frame 15 |
| Contig37287_RC | −0.513324 | | ESTs |
| NM_000355 | −0.513225 | TCN2 | transcobalamin II; macrocytic anemia |
| AB037756 | 0.512914 | KIAA1335 | hypothetical protein KIAA1335 |
| Contig842_RC | −0.512880 | | ESTs |
| NM_018186 | −0.512878 | FLJ10706 | hypothetical protein FLJ10706 |
| NM_014668 | 0.512746 | KIAA0575 | KIAA0575 gene product |
| NM_003226 | 0.512611 | TFF3 | trefoil factor 3 (intestinal) |
| Contig56457_RC | −0.512548 | TMEFF1 | transmembrane protein with EGF-like and two follistatin-like domains 1 |
| AL050367 | −0.511999 | | *Homo sapiens* mRNA; cDNA DKFZp564A026 (from clone DKFZp564A026) |
| NM_014791 | −0.511963 | KIAA0175 | KIAA0175 gene product |
| Contig36312_RC | 0.511794 | | ESTs |
| NM_004811 | −0.511447 | LPXN | leupaxin |
| Contig67182_RC | −0.511416 | | ESTs, Highly similar to epithelial V-like antigen precursor [*H. sapiens*] |
| Contig52723_RC | −0.511134 | | ESTs |
| Contig17105_RC | −0.511072 | | *Homo sapiens* mRNA for putative cytoplasmatic protein (ORF1-FL21) |
| NM_014449 | 0.511023 | A | protein "A" |
| Contig52957_RC | 0.510815 | | ESTs |
| Contig49388_RC | 0.510582 | FLJ13322 | hypothetical protein FLJ13322 |
| NM_017786 | 0.510557 | FLJ20366 | hypothetical protein FLJ20366 |
| AL157476 | 0.510478 | | *Homo sapiens* mRNA; cDNA DKFZp761C082 (from clone DKFZp761C082) |
| NM_001919 | 0.510242 | DCI | dodecenoyl-Coenzyme A delta isomerase (3,2 trans-enoyl-Coenzyme A isomerase) |
| NM_000268 | −0.510165 | NF2 | neurofibromin 2 (bilateral acoustic neuroma) |
| NM_016210 | 0.510018 | LOC51161 | g20 protein |
| Contig45816_RC | −0.509977 | | ESTs |
| NM_003953 | −0.509969 | MPZL1 | myelin protein zero-like 1 |
| NM_000057 | −0.509669 | BLM | Bloom syndrome |
| NM_014452 | −0.509473 | DR6 | death receptor 6 |
| Contig45156_RC | 0.509284 | | ESTs, Moderately similar to motor domain of KIF12 [*M. musculus*] |

TABLE 2-continued 550 preferred ER status markers drawn from Table 1.

| Identifier | Correlation | Name | Description |
|---|---|---|---|
| NM_006943 | 0.509149 | SOX22 | SRY (sex determining region Y)-box 22 |
| NM_000594 | −0.509012 | TNF | tumor necrosis factor (TNF superfamily, member 2) |
| AL137316 | −0.508353 | KIAA1609 | KIAA1609 protein |
| NM_000557 | −0.508325 | GDF5 | growth differentiation factor 5 (cartilage-derived morphogenetic protein-1) |
| NM_018685 | −0.508307 | ANLN | anillin (Drosophila Scraps homolog), actin binding protein |
| Contig53401_RC | 0.508189 | | ESTs |
| NM_014364 | −0.508170 | GAPDS | glyceraldehyde-3-phosphate dehydrogenase, testis-specific |
| Contig50297_RC | 0.508137 | | ESTs, Moderately similar to ALU8_HUMAN ALU SUBFAMILY SX SEQUENCE CONTAMINATION WARNING ENTRY [*H. sapiens*] |
| Contig51800 | 0.507891 | | ESTs, Weakly similar to ALU6_HUMAN ALU SUBFAMILY SP SEQUENCE CONTAMINATION WARNING ENTRY [*H. sapiens*] |
| Contig49098_RC | −0.507716 | MGC4090 | hypothetical protein MGC4090 |
| NM_002985 | −0.507554 | SCYA5 | small inducible cytokine A5 (RANTES) |
| AB007899 | 0.507439 | KIAA0439 | KIAA0439 protein; homolog of yeast ubiquitin-protein ligase Rsp5 |
| AL110139 | 0.507145 | | *Homo sapiens* mRNA; cDNA DKFZp564O1763 (from clone DKFZp564O1763) |
| Contig51117_RC | 0.507001 | | ESTs |
| NM_017660 | −0.506768 | FLJ20085 | hypothetical protein FLJ20085 |
| NM_018000 | 0.506686 | FLJ10116 | hypothetical protein FLJ10116 |
| NM_005555 | −0.506516 | KRT6B | keratin 6B |
| NM_005582 | −0.506462 | LY64 | lymphocyte antigen 64 (mouse) homolog, radioprotective, 105 kD |
| Contig47405_RC | 0.506202 | | ESTs |
| NM_014808 | 0.506173 | KIAA0793 | KIAA0793 gene product |
| NM_004938 | −0.506121 | DAPK1 | death-associated protein kinase 1 |
| NM_020659 | −0.505793 | TTYH1 | tweety (*Drosophila*) homolog 1 |
| NM_006227 | −0.505604 | PLTP | phospholipid transfer protein |
| NM_014268 | −0.505412 | MAPRE2 | microtubule-associated protein, RP/EB family, member 2 |
| NM_004711 | 0.504849 | SYNGR1 | synaptogyrin 1 |
| NM_004418 | −0.504497 | DUSP2 | dual specificity phosphatase 2 |
| NM_003508 | −0.504475 | FZD9 | frizzled (*Drosophila*) homolog 9 |

TABLE 3

430 gene markers that distinguish BRCA1-related tumor samples from sporadic tumor samples

| GenBank Accession Number | SEQ ID NO |
|---|---|
| AB002301 | SEQ ID NO 4 |
| AB004857 | SEQ ID NO 8 |
| AB007458 | SEQ ID NO 12 |
| AB014534 | SEQ ID NO 29 |
| AB018305 | SEQ ID NO 34 |
| AB020677 | SEQ ID NO 36 |
| AB020689 | SEQ ID NO 37 |
| AB023151 | SEQ ID NO 41 |
| AB023163 | SEQ ID NO 43 |
| AB028986 | SEQ ID NO 48 |
| AB029025 | SEQ ID NO 50 |
| AB032966 | SEQ ID NO 53 |
| AB032988 | SEQ ID NO 57 |
| AB033049 | SEQ ID NO 63 |
| AB033055 | SEQ ID NO 66 |
| AB037742 | SEQ ID NO 73 |
| AB041269 | SEQ ID NO 96 |
| AF000974 | SEQ ID NO 97 |
| AF042838 | SEQ ID NO 111 |
| AF052155 | SEQ ID NO 119 |
| AF055084 | SEQ ID NO 125 |
| AF063725 | SEQ ID NO 129 |
| AF070536 | SEQ ID NO 133 |
| AF070617 | SEQ ID NO 135 |
| AF073299 | SEQ ID NO 136 |
| AF079529 | SEQ ID NO 140 |
| AF090353 | SEQ ID NO 141 |
| AF116238 | SEQ ID NO 155 |
| AF151810 | SEQ ID NO 171 |
| AF220492 | SEQ ID NO 185 |
| AJ224741 | SEQ ID NO 196 |
| AJ250475 | SEQ ID NO 201 |
| AJ270996 | SEQ ID NO 202 |
| AJ272057 | SEQ ID NO 203 |

TABLE 3-continued 430 gene markers that distinguish BRCA1-related tumor samples from sporadic tumor samples

| GenBank Accession Number | SEQ ID NO |
|---|---|
| AK000174 | SEQ ID NO 211 |
| AK000617 | SEQ ID NO 215 |
| AK000959 | SEQ ID NO 222 |
| AK001438 | SEQ ID NO 229 |
| AK001838 | SEQ ID NO 233 |
| AK002107 | SEQ ID NO 238 |
| AK002197 | SEQ ID NO 239 |
| AL035297 | SEQ ID NO 241 |
| AL049346 | SEQ ID NO 243 |
| AL049370 | SEQ ID NO 245 |
| AL049667 | SEQ ID NO 249 |
| AL080222 | SEQ ID NO 276 |
| AL096737 | SEQ ID NO 279 |
| AL110163 | SEQ ID NO 282 |
| AL133057 | SEQ ID NO 300 |
| AL133096 | SEQ ID NO 302 |
| AL133572 | SEQ ID NO 305 |
| AL133619 | SEQ ID NO 307 |
| AL133623 | SEQ ID NO 309 |
| AL137347 | SEQ ID NO 320 |
| AL137381 | SEQ ID NO 322 |
| AL137461 | SEQ ID NO 325 |
| AL137540 | SEQ ID NO 328 |
| AL137555 | SEQ ID NO 329 |
| AL137638 | SEQ ID NO 332 |
| AL137639 | SEQ ID NO 333 |
| AL137663 | SEQ ID NO 334 |
| AL137761 | SEQ ID NO 339 |
| AL157431 | SEQ ID NO 340 |
| AL161960 | SEQ ID NO 351 |
| AL355708 | SEQ ID NO 353 |
| AL359053 | SEQ ID NO 354 |
| D26488 | SEQ ID NO 359 |
| D38521 | SEQ ID NO 361 |
| D50914 | SEQ ID NO 367 |
| D80001 | SEQ ID NO 369 |
| G26403 | SEQ ID NO 380 |
| K02276 | SEQ ID NO 383 |
| M21551 | SEQ ID NO 394 |
| M27749 | SEQ ID NO 397 |
| M28170 | SEQ ID NO 398 |
| M73547 | SEQ ID NO 409 |
| M80899 | SEQ ID NO 411 |
| NM_000067 | SEQ ID NO 423 |
| NM_000087 | SEQ ID NO 427 |
| NM_000090 | SEQ ID NO 428 |
| NM_000165 | SEQ ID NO 444 |
| NM_000168 | SEQ ID NO 445 |
| NM_000196 | SEQ ID NO 449 |
| NM_000269 | SEQ ID NO 457 |
| NM_000310 | SEQ ID NO 466 |
| NM_000396 | SEQ ID NO 479 |
| NM_000397 | SEQ ID NO 480 |
| NM_000597 | SEQ ID NO 502 |
| NM_000636 | SEQ ID NO 509 |
| NM_000888 | SEQ ID NO 535 |
| NM_000903 | SEQ ID NO 536 |
| NM_000930 | SEQ ID NO 540 |
| NM_000931 | SEQ ID NO 541 |
| NM_000969 | SEQ ID NO 547 |
| NM_000984 | SEQ ID NO 548 |
| NM_001026 | SEQ ID NO 552 |
| NM_001054 | SEQ ID NO 554 |
| NM_001179 | SEQ ID NO 567 |
| NM_001184 | SEQ ID NO 568 |
| NM_001204 | SEQ ID NO 571 |
| NM_001206 | SEQ ID NO 572 |
| NM_001218 | SEQ ID NO 575 |
| NM_001275 | SEQ ID NO 586 |
| NM_001394 | SEQ ID NO 602 |
| NM_001424 | SEQ ID NO 605 |
| NM_001448 | SEQ ID NO 610 |
| NM_001504 | SEQ ID NO 620 |
| NM_001553 | SEQ ID NO 630 |
| NM_001674 | SEQ ID NO 646 |
| NM_001675 | SEQ ID NO 647 |
| NM_001725 | SEQ ID NO 652 |
| NM_001740 | SEQ ID NO 656 |
| NM_001756 | SEQ ID NO 659 |
| NM_001770 | SEQ ID NO 664 |
| NM_001797 | SEQ ID NO 670 |
| NM_001845 | SEQ ID NO 680 |
| NM_001873 | SEQ ID NO 684 |
| NM_001888 | SEQ ID NO 687 |
| NM_001892 | SEQ ID NO 688 |
| NM_001919 | SEQ ID NO 694 |
| NM_001946 | SEQ ID NO 698 |
| NM_001953 | SEQ ID NO 699 |
| NM_001960 | SEQ ID NO 704 |
| NM_001985 | SEQ ID NO 709 |
| NM_002023 | SEQ ID NO 712 |
| NM_002051 | SEQ ID NO 716 |
| NM_002053 | SEQ ID NO 717 |
| NM_002164 | SEQ ID NO 734 |
| NM_002200 | SEQ ID NO 739 |
| NM_002201 | SEQ ID NO 740 |
| NM_002213 | SEQ ID NO 741 |
| NM_002250 | SEQ ID NO 747 |
| NM_002512 | SEQ ID NO 780 |
| NM_002542 | SEQ ID NO 784 |
| NM_002561 | SEQ ID NO 786 |
| NM_002615 | SEQ ID NO 793 |
| NM_002686 | SEQ ID NO 803 |
| NM_002709 | SEQ ID NO 806 |
| NM_002742 | SEQ ID NO 812 |
| NM_002775 | SEQ ID NO 815 |
| NM_002975 | SEQ ID NO 848 |
| NM_002982 | SEQ ID NO 849 |
| NM_003104 | SEQ ID NO 870 |
| NM_003118 | SEQ ID NO 872 |
| NM_003144 | SEQ ID NO 876 |
| NM_003165 | SEQ ID NO 882 |
| NM_003197 | SEQ ID NO 885 |
| NM_003202 | SEQ ID NO 886 |
| NM_003217 | SEQ ID NO 888 |
| NM_003283 | SEQ ID NO 898 |
| NM_003462 | SEQ ID NO 911 |
| NM_003500 | SEQ ID NO 918 |
| NM_003561 | SEQ ID NO 925 |
| NM_003607 | SEQ ID NO 930 |
| NM_003633 | SEQ ID NO 933 |
| NM_003641 | SEQ ID NO 934 |
| NM_003683 | SEQ ID NO 943 |
| NM_003729 | SEQ ID NO 949 |
| NM_003793 | SEQ ID NO 954 |
| NM_003829 | SEQ ID NO 958 |
| NM_003866 | SEQ ID NO 961 |
| NM_003904 | SEQ ID NO 967 |
| NM_003953 | SEQ ID NO 974 |
| NM_004024 | SEQ ID NO 982 |
| NM_004053 | SEQ ID NO 986 |
| NM_004295 | SEQ ID NO 1014 |
| NM_004438 | SEQ ID NO 1038 |
| NM_004559 | SEQ ID NO 1057 |
| NM_004616 | SEQ ID NO 1065 |
| NM_004741 | SEQ ID NO 1080 |
| NM_004772 | SEQ ID NO 1084 |
| NM_004791 | SEQ ID NO 1086 |
| NM_004848 | SEQ ID NO 1094 |
| NM_004866 | SEQ ID NO 1097 |
| NM_005128 | SEQ ID NO 1121 |
| NM_005148 | SEQ ID NO 1124 |
| NM_005196 | SEQ ID NO 1127 |
| NM_005326 | SEQ ID NO 1140 |
| NM_005518 | SEQ ID NO 1161 |
| NM_005538 | SEQ ID NO 1163 |

TABLE 3-continued 430 gene markers that distinguish BRCA1-related tumor samples from sporadic tumor samples

| GenBank Accession Number | SEQ ID NO |
|---|---|
| NM_005557 | SEQ ID NO 1170 |
| NM_005718 | SEQ ID NO 1189 |
| NM_005804 | SEQ ID NO 1201 |
| NM_005824 | SEQ ID NO 1203 |
| NM_005935 | SEQ ID NO 1220 |
| NM_006002 | SEQ ID NO 1225 |
| NM_006148 | SEQ ID NO 1249 |
| NM_006235 | SEQ ID NO 1257 |
| NM_006271 | SEQ ID NO 1261 |
| NM_006287 | SEQ ID NO 1264 |
| NM_006296 | SEQ ID NO 1267 |
| NM_006378 | SEQ ID NO 1275 |
| NM_006461 | SEQ ID NO 1287 |
| NM_006573 | SEQ ID NO 1300 |
| NM_006622 | SEQ ID NO 1302 |
| NM_006696 | SEQ ID NO 1308 |
| NM_006769 | SEQ ID NO 1316 |
| NM_006787 | SEQ ID NO 1319 |
| NM_006875 | SEQ ID NO 1334 |
| NM_006885 | SEQ ID NO 1335 |
| NM_006918 | SEQ ID NO 1339 |
| NM_006923 | SEQ ID NO 1340 |
| NM_006941 | SEQ ID NO 1342 |
| NM_007070 | SEQ ID NO 1354 |
| NM_007088 | SEQ ID NO 1356 |
| NM_007146 | SEQ ID NO 1358 |
| NM_007173 | SEQ ID NO 1359 |
| NM_007246 | SEQ ID NO 1366 |
| NM_007358 | SEQ ID NO 1374 |
| NM_012135 | SEQ ID NO 1385 |
| NM_012151 | SEQ ID NO 1387 |
| NM_012258 | SEQ ID NO 1396 |
| NM_012317 | SEQ ID NO 1399 |
| NM_012337 | SEQ ID NO 1403 |
| NM_012339 | SEQ ID NO 1404 |
| NM_012391 | SEQ ID NO 1406 |
| NM_012428 | SEQ ID NO 1412 |
| NM_013233 | SEQ ID NO 1418 |
| NM_013253 | SEQ ID NO 1422 |
| NM_013262 | SEQ ID NO 1425 |
| NM_013372 | SEQ ID NO 1434 |
| NM_013378 | SEQ ID NO 1435 |
| NM_014096 | SEQ ID NO 1450 |
| NM_014242 | SEQ ID NO 1464 |
| NM_014314 | SEQ ID NO 1472 |
| NM_014398 | SEQ ID NO 1486 |
| NM_014402 | SEQ ID NO 1488 |
| NM_014476 | SEQ ID NO 1496 |
| NM_014521 | SEQ ID NO 1499 |
| NM_014585 | SEQ ID NO 1504 |
| NM_014597 | SEQ ID NO 1506 |
| NM_014642 | SEQ ID NO 1510 |
| NM_014679 | SEQ ID NO 1517 |
| NM_014680 | SEQ ID NO 1518 |
| NM_014700 | SEQ ID NO 1520 |
| NM_014723 | SEQ ID NO 1523 |
| NM_014770 | SEQ ID NO 1530 |
| NM_014785 | SEQ ID NO 1534 |
| NM_014817 | SEQ ID NO 1539 |
| NM_014840 | SEQ ID NO 1541 |
| NM_014878 | SEQ ID NO 1546 |
| NM_015493 | SEQ ID NO 1564 |
| NM_015523 | SEQ ID NO 1568 |
| NM_015544 | SEQ ID NO 1570 |
| NM_015623 | SEQ ID NO 1572 |
| NM_015640 | SEQ ID NO 1573 |
| NM_015721 | SEQ ID NO 1576 |
| NM_015881 | SEQ ID NO 1577 |
| NM_015937 | SEQ ID NO 1582 |
| NM_015964 | SEQ ID NO 1586 |
| NM_015984 | SEQ ID NO 1587 |
| NM_016000 | SEQ ID NO 1591 |
| NM_016018 | SEQ ID NO 1593 |
| NM_016066 | SEQ ID NO 1601 |
| NM_016073 | SEQ ID NO 1603 |
| NM_016081 | SEQ ID NO 1604 |
| NM_016140 | SEQ ID NO 1611 |
| NM_016223 | SEQ ID NO 1622 |
| NM_016267 | SEQ ID NO 1629 |
| NM_016307 | SEQ ID NO 1633 |
| NM_016364 | SEQ ID NO 1639 |
| NM_016373 | SEQ ID NO 1640 |
| NM_016459 | SEQ ID NO 1646 |
| NM_016471 | SEQ ID NO 1648 |
| NM_016548 | SEQ ID NO 1654 |
| NM_016620 | SEQ ID NO 1662 |
| NM_016820 | SEQ ID NO 1674 |
| NM_017423 | SEQ ID NO 1678 |
| NM_017709 | SEQ ID NO 1698 |
| NM_017732 | SEQ ID NO 1700 |
| NM_017734 | SEQ ID NO 1702 |
| NM_017750 | SEQ ID NO 1704 |
| NM_017763 | SEQ ID NO 1706 |
| NM_017782 | SEQ ID NO 1710 |
| NM_017816 | SEQ ID NO 1714 |
| NM_018043 | SEQ ID NO 1730 |
| NM_018072 | SEQ ID NO 1734 |
| NM_018093 | SEQ ID NO 1738 |
| NM_018103 | SEQ ID NO 1742 |
| NM_018171 | SEQ ID NO 1751 |
| NM_018187 | SEQ ID NO 1755 |
| NM_018188 | SEQ ID NO 1756 |
| NM_018222 | SEQ ID NO 1761 |
| NM_018228 | SEQ ID NO 1762 |
| NM_018373 | SEQ ID NO 1777 |
| NM_018390 | SEQ ID NO 1781 |
| NM_018422 | SEQ ID NO 1784 |
| NM_018509 | SEQ ID NO 1792 |
| NM_018584 | SEQ ID NO 1796 |
| NM_018653 | SEQ ID NO 1797 |
| NM_018660 | SEQ ID NO 1798 |
| NM_018683 | SEQ ID NO 1799 |
| NM_019049 | SEQ ID NO 1814 |
| NM_019063 | SEQ ID NO 1815 |
| NM_020150 | SEQ ID NO 1823 |
| NM_020987 | SEQ ID NO 1848 |
| NM_021095 | SEQ ID NO 1855 |
| NM_021242 | SEQ ID NO 1867 |
| U41387 | SEQ ID NO 1877 |
| U45975 | SEQ ID NO 1878 |
| U58033 | SEQ ID NO 1881 |
| U67784 | SEQ ID NO 1884 |
| U68385 | SEQ ID NO 1885 |
| U80736 | SEQ ID NO 1890 |
| X00437 | SEQ ID NO 1899 |
| X07203 | SEQ ID NO 1904 |
| X16302 | SEQ ID NO 1907 |
| X51630 | SEQ ID NO 1908 |
| X57809 | SEQ ID NO 1912 |
| X57819 | SEQ ID NO 1913 |
| X58529 | SEQ ID NO 1914 |

TABLE 3-continued

430 gene markers that distinguish BRCA1-related tumor samples from sporadic tumor samples

| GenBank Accession Number | SEQ ID NO |
| --- | --- |
| X66087 | SEQ ID NO 1916 |
| X69150 | SEQ ID NO 1917 |
| X72475 | SEQ ID NO 1918 |
| X74794 | SEQ ID NO 1920 |
| X75315 | SEQ ID NO 1921 |
| X84340 | SEQ ID NO 1925 |
| X98260 | SEQ ID NO 1928 |
| Y07512 | SEQ ID NO 1931 |
| Y14737 | SEQ ID NO 1932 |
| Z34893 | SEQ ID NO 1934 |
| Contig237_RC | SEQ ID NO 1940 |
| Contig292_RC | SEQ ID NO 1942 |
| Contig372_RC | SEQ ID NO 1943 |
| Contig756_RC | SEQ ID NO 1955 |
| Contig842_RC | SEQ ID NO 1958 |
| Contig1632_RC | SEQ ID NO 1977 |
| Contig1826_RC | SEQ ID NO 1980 |
| Contig2237_RC | SEQ ID NO 1988 |
| Contig2915_RC | SEQ ID NO 2003 |
| Contig3164_RC | SEQ ID NO 2007 |
| Contig3252_RC | SEQ ID NO 2008 |
| Contig3940_RC | SEQ ID NO 2018 |
| Contig9259_RC | SEQ ID NO 2039 |
| Contig10268_RC | SEQ ID NO 2041 |
| Contig10437_RC | SEQ ID NO 2043 |
| Contig10973_RC | SEQ ID NO 2044 |
| Contig14390_RC | SEQ ID NO 2054 |
| Contig16453_RC | SEQ ID NO 2060 |
| Contig16759_RC | SEQ ID NO 2061 |
| Contig19551 | SEQ ID NO 2070 |
| Contig24541_RC | SEQ ID NO 2088 |
| Contig25362_RC | SEQ ID NO 2093 |
| Contig25617_RC | SEQ ID NO 2094 |
| Contig25722_RC | SEQ ID NO 2096 |
| Contig26022_RC | SEQ ID NO 2099 |
| Contig27915_RC | SEQ ID NO 2114 |
| Contig28081_RC | SEQ ID NO 2116 |
| Contig28179_RC | SEQ ID NO 2118 |
| Contig28550_RC | SEQ ID NO 2119 |
| Contig29639_RC | SEQ ID NO 2127 |
| Contig29647_RC | SEQ ID NO 2128 |
| Contig30092_RC | SEQ ID NO 2130 |
| Contig30209_RC | SEQ ID NO 2132 |
| Contig32185_RC | SEQ ID NO 2156 |
| Contig32798_RC | SEQ ID NO 2161 |
| Contig33230_RC | SEQ ID NO 2163 |
| Contig33394_RC | SEQ ID NO 2165 |
| Contig36323_RC | SEQ ID NO 2197 |
| Contig36761_RC | SEQ ID NO 2201 |
| Contig37141_RC | SEQ ID NO 2209 |
| Contig37778_RC | SEQ ID NO 2218 |
| Contig38285_RC | SEQ ID NO 2222 |
| Contig38520_RC | SEQ ID NO 2225 |
| Contig38901_RC | SEQ ID NO 2232 |
| Contig39826_RC | SEQ ID NO 2241 |
| Contig40212_RC | SEQ ID NO 2251 |
| Contig40712_RC | SEQ ID NO 2257 |
| Contig41402_RC | SEQ ID NO 2265 |
| Contig41635_RC | SEQ ID NO 2272 |
| Contig42006_RC | SEQ ID NO 2280 |
| Contig42220_RC | SEQ ID NO 2286 |
| Contig42306_RC | SEQ ID NO 2287 |
| Contig43918_RC | SEQ ID NO 2312 |
| Contig44195_RC | SEQ ID NO 2316 |
| Contig44265_RC | SEQ ID NO 2318 |
| Contig44278_RC | SEQ ID NO 2319 |
| Contig44757_RC | SEQ ID NO 2329 |
| Contig45588_RC | SEQ ID NO 2349 |
| Contig46262_RC | SEQ ID NO 2361 |
| Contig46288_RC | SEQ ID NO 2362 |
| Contig46343_RC | SEQ ID NO 2363 |
| Contig46452_RC | SEQ ID NO 2366 |
| Contig46868_RC | SEQ ID NO 2373 |
| Contig46937_RC | SEQ ID NO 2377 |
| Contig48004_RC | SEQ ID NO 2393 |
| Contig48249_RC | SEQ ID NO 2397 |
| Contig48774_RC | SEQ ID NO 2405 |
| Contig48913_RC | SEQ ID NO 2411 |
| Contig48945_RC | SEQ ID NO 2412 |
| Contig48970_RC | SEQ ID NO 2413 |
| Contig49233_RC | SEQ ID NO 2419 |
| Contig49289_RC | SEQ ID NO 2422 |
| Contig49342_RC | SEQ ID NO 2423 |
| Contig49510_RC | SEQ ID NO 2430 |
| Contig49855 | SEQ ID NO 2440 |
| Contig49948_RC | SEQ ID NO 2442 |
| Contig50297_RC | SEQ ID NO 2451 |
| Contig50669_RC | SEQ ID NO 2458 |
| Contig50673_RC | SEQ ID NO 2459 |
| Contig50838_RC | SEQ ID NO 2465 |
| Contig51068_RC | SEQ ID NO 2471 |
| Contig51929 | SEQ ID NO 2492 |
| Contig51953_RC | SEQ ID NO 2493 |
| Contig52405_RC | SEQ ID NO 2502 |
| Contig52543_RC | SEQ ID NO 2505 |
| Contig52720_RC | SEQ ID NO 2513 |
| Contig53281_RC | SEQ ID NO 2530 |
| Contig53598_RC | SEQ ID NO 2537 |
| Contig53757_RC | SEQ ID NO 2543 |
| Contig53944_RC | SEQ ID NO 2545 |
| Contig54425 | SEQ ID NO 2561 |
| Contig54547_RC | SEQ ID NO 2565 |
| Contig54757_RC | SEQ ID NO 2574 |
| Contig54916_RC | SEQ ID NO 2581 |
| Contig55770_RC | SEQ ID NO 2604 |
| Contig55801_RC | SEQ ID NO 2606 |
| Contig56143_RC | SEQ ID NO 2619 |
| Contig56160_RC | SEQ ID NO 2620 |
| Contig56303_RC | SEQ ID NO 2626 |
| Contig57023_RC | SEQ ID NO 2639 |
| Contig57138_RC | SEQ ID NO 2644 |
| Contig57609_RC | SEQ ID NO 2657 |
| Contig58301_RC | SEQ ID NO 2667 |
| Contig58512_RC | SEQ ID NO 2670 |
| Contig60393 | SEQ ID NO 2674 |
| Contig60509_RC | SEQ ID NO 2675 |
| Contig61254_RC | SEQ ID NO 2677 |
| Contig62306 | SEQ ID NO 2680 |
| Contig64502 | SEQ ID NO 2689 |

TABLE 4

100 preferred markers from Table 3 distinguishing BRCA1-related tumors from sporadic tumors.

| Identifier | Correlation | Sequence Name | Description |
|---|---|---|---|
| NM_001892 | −0.651689 | CSNK1A1 | casein kinase 1, alpha 1 |
| NM_018171 | −0.637696 | FLJ10659 | hypothetical protein FLJ10659 |
| Contig40712_RC | −0.612509 | | ESTs |
| NM_001204 | −0.608470 | BMPR2 | bone morphogenetic protein receptor, type II (serine/threonine kinase) |
| NM_005148 | −0.598612 | UNC119 | unc119 (*C. elegans*) homolog |
| G26403 | 0.585054 | YWHAH | tyrosine 3-monooxygenase/tryptophan 5-monooxygenase activation protein, eta polypeptide |
| NM_015640 | 0.583397 | PAI-RBP1 | PAI-1 mRNA-binding protein |
| Contig9259_RC | 0.581362 | | ESTs |
| AB033049 | −0.578750 | KIAA1223 | KIAA1223 protein |
| NM_015523 | 0.576029 | DKFZP566E144 | small fragment nuclease |
| Contig41402_RC | −0.571650 | | Human DNA sequence from clone RP11-16L21 on chromosome 9. Contains the gene for NADP-dependent leukotriene B4 12-hydroxydehydrogenase, the gene for a novel DnaJ domain protein similar to *Drosophila*, *C. elegans* and Arabidopsis predicted proteins, the GNG10 gene for guanine nucleotide binding protein 10, a novel gene, ESTs, STSs, GSSs and six CpG islands |
| NM_004791 | −0.564819 | ITGBL1 | integrin, beta-like 1 (with EGF-like repeat domains) |
| NM_007070 | 0.561173 | FAP48 | FKBP-associated protein |
| NM_014597 | 0.555907 | HSU15552 | acidic 82 kDa protein mRNA |
| AF000974 | 0.547194 | TRIP6 | thyroid hormone receptor interactor 6 |
| NM_016073 | −0.547072 | CGI-142 | CGI-142 |
| Contig3940_RC | 0.544073 | YWHAH | tyrosine 3-monooxygenase/tryptophan 5-monooxygenase activation protein, eta polypeptide |
| NM_003683 | 0.542219 | D21S2056E | DNA segment on chromosome 21 (unique) 2056 expressed sequence |
| Contig58512_RC | −0.528458 | | *Homo sapiens* pancreas tumor-related protein (FKSG12) mRNA, complete cds |
| NM_003904 | 0.521223 | ZNF259 | zinc finger protein 259 |
| Contig26022_RC | 0.517351 | | ESTs |
| Contig48970_RC | −0.516953 | KIAA0892 | KIAA0892 protein |
| NM_016307 | −0.515398 | PRX2 | paired related homeobox protein |
| AL137761 | −0.514891 | | *Homo sapiens* mRNA; cDNA DKFZp586L2424 (from clone DKFZp586L2424) |
| NM_001919 | −0.514799 | DCI | dodecenoyl-Coenzyme A delta isomerase (3,2 trans-enoyl-Coenzyme A isomerase) |
| NM_000196 | −0.514004 | HSD11B2 | hydroxysteroid (11-beta) dehydrogenase 2 |
| NM_002200 | 0.513149 | IRF5 | interferon regulatory factor 5 |
| AL133572 | 0.511340 | | *Homo sapiens* mRNA; cDNA DKFZp434I0535 (from clone DKFZp434I0535); partial cds |
| NM_019063 | 0.511127 | C2ORF2 | chromosome 2 open reading frame 2 |
| Contig25617_RC | 0.509506 | | ESTs |
| NM_007358 | 0.508145 | M96 | putative DNA binding protein |
| NM_014785 | −0.507114 | KIAA0258 | KIAA0258 gene product |
| NM_006235 | 0.506585 | POU2AF1 | POU domain, class 2, associating factor 1 |
| NM_014680 | −0.505779 | KIAA0100 | KIAA0100 gene product |
| X66087 | 0.500842 | MYBL1 | v-myb avian myeloblastosis viral oncogene homolog-like 1 |
| Y07512 | −0.500686 | PRKG1 | protein kinase, cGMP-dependent, type I |
| NM_006296 | 0.500344 | VRK2 | vaccinia related kinase 2 |
| Contig44278_RC | 0.498260 | DKFZP434K114 | DKFZP434K114 protein |
| Contig56160_RC | −0.497695 | | ESTs |
| NM_002023 | −0.497570 | FMOD | fibromodulin |

TABLE 4-continued 100 preferred markers from Table 3 distinguishing BRCA1-related tumors from sporadic tumors.

| Identifier | Correlation | Sequence Name | Description |
|---|---|---|---|
| M28170 | 0.497095 | CD19 | CD19 antigen |
| D26488 | 0.496511 | KIAA0007 | KIAA0007 protein |
| X72475 | 0.496125 | | *H. sapiens* mRNA for rearranged Ig kappa light chain variable region (I.114) |
| K02276 | 0.496068 | MYC | v-myc avian myelocytomatosis viral oncogene homolog |
| NM_013378 | 0.495648 | VPREB3 | pre-B lymphocyte gene 3 |
| X58529 | 0.495608 | IGHM | immunoglobulin heavy constant mu |
| NM_000168 | −0.494260 | GLI3 | GLI-Kruppel family member GLI3 (Greig cephalopolysyndactyly syndrome) |
| NM_004866 | −0.492967 | SCAMP1 | secretory carrier membrane protein 1 |
| NM_013253 | −0.491159 | DKK3 | dickkopf (*Xenopus laevis*) homolog 3 |
| NM_003729 | 0.488971 | RPC | RNA 3'-terminal phosphate cyclase |
| NM_006875 | 0.487407 | PIM2 | pim-2 oncogene |
| NM_018188 | 0.487126 | FLJ10709 | hypothetical protein FLJ10709 |
| NM_004848 | 0.485408 | ICB-1 | basement membrane-induced gene |
| NM_001179 | 0.483253 | ART3 | ADP-ribosyltransferase 3 |
| NM_016548 | −0.482329 | LOC51280 | golgi membrane protein GP73 |
| NM_007146 | −0.481994 | ZNF161 | zinc finger protein 161 |
| NM_021242 | −0.481754 | STRAIT11499 | hypothetical protein STRAIT11499 |
| NM_016223 | 0.481710 | PACSIN3 | protein kinase C and casein kinase substrate in neurons 3 |
| NM_003197 | −0.481526 | TCEB1L | transcription elongation factor B (SIII), polypeptide 1-like |
| NM_000067 | −0.481003 | CA2 | carbonic anhydrase II |
| NM_006885 | −0.479705 | ATBF1 | AT-binding transcription factor 1 |
| NM_002542 | 0.478282 | OGG1 | 8-oxoguanine DNA glycosylase |
| AL133619 | −0.476596 | | *Homo sapiens* mRNA; cDNA DKFZp434E2321 (from clone DKFZp434E2321); partial cds |
| D80001 | 0.476130 | KIAA0179 | KIAA0179 protein |
| NM_018660 | −0.475548 | LOC55893 | papillomavirus regulatory factor PRF-1 |
| AB004857 | 0.473440 | SLC11A2 | solute carrier family 11 (proton-coupled divalent metal ion transporters), member 2 |
| NM_002250 | 0.472900 | KCNN4 | potassium intermediate/small conductance calcium-activated channel, subfamily N, member 4 |
| Contig56143_RC | −0.472611 | | ESTs, Weakly similar to A54849 collagen alpha 1(VII) chain precursor [*H. sapiens*] |
| NM_001960 | 0.471502 | EEF1D | eukaryotic translation elongation factor 1 delta (guanine nucleotide exchange protein) |
| Contig52405_RC | −0.470705 | | ESTs, Weakly similar to ALU8_HUMAN ALU SUBFAMILY SX SEQUENCE CONTAMINATION WARNING ENTRY [*H. sapiens*] |
| Contig30092_RC | −0.469977 | | *Homo sapiens* PR-domain zinc finger protein 6 isoform B (PRDM6) mRNA, partial cds; alternatively spliced |
| NM_003462 | −0.468753 | P28 | dynein, axonemal, light intermediate polypeptide |
| Contig60393 | 0.468475 | | ESTs |
| Contig842_RC | 0.468158 | | ESTs |
| NM_002982 | 0.466362 | SCYA2 | small inducible cytokine A2 (monocyte chemotactic protein 1, homologous to mouse Sig-je) |
| Contig14390_RC | 0.464150 | | ESTs |
| NM_001770 | 0.463847 | CD19 | CD19 antigen |
| AK000617 | −0.463158 | | *Homo sapiens* mRNA; cDNA DKFZp434L235 (from clone DKFZp434L235) |
| AF073299 | −0.463007 | SLC9A2 | solute carrier family 9 (sodium/hydrogen exchanger), isoform 2 |
| NM_019049 | 0.461990 | FLJ20054 | hypothetical protein |
| AL137347 | −0.460778 | DKFZP761M1511 | hypothetical protein |
| NM_000396 | −0.460263 | CTSK | cathepsin K (pycnodysostosis) |

TABLE 4-continued 100 preferred markers from Table 3 distinguishing BRCA1-related tumors from sporadic tumors.

| Identifier | Correlation | Sequence Name | Description |
|---|---|---|---|
| NM_018373 | −0.459268 | FLJ11271 | hypothetical protein FLJ11271 |
| NM_002709 | 0.458500 | PPP1CB | protein phosphatase 1, catalytic subunit, beta isoform |
| NM_016820 | 0.457516 | OGG1 | 8-oxoguanine DNA glycosylase |
| Contig10268_RC | 0.456933 | | Human DNA sequence from clone RP11-196N14 on chromosome 20 Contains ESTs, STSs, GSSs and CpG islands. Contains three novel genes, part of a gene for a novel protein similar to protein serine/threonine phosphatase 4 regulatory subunit 1 (PP4R1) and a gene for a novel protein with an ankyrin domain |
| NM_014521 | −0.456733 | SH3BP4 | SH3-domain binding protein 4 |
| AJ272057 | −0.456548 | STRAIT11499 | hypothetical protein STRAIT11499 |
| NM_015964 | −0.456187 | LOC51673 | brain specific protein |
| Contig16759_RC | −0.456169 | | ESTs |
| NM_015937 | −0.455954 | LOC51604 | CGI-06 protein |
| NM_007246 | −0.455500 | KLHL2 | kelch (*Drosophila*)-like 2 (Mayven) |
| NM_001985 | −0.453024 | ETFB | electron-transfer-flavoprotein, beta polypeptide |
| NM_000984 | −0.452935 | RPL23A | ribosomal protein L23a |
| Contig51953_RC | −0.451695 | | ESTs |
| NM_015984 | 0.450491 | UCH37 | ubiquitin C-terminal hydrolase UCH37 |
| NM_000903 | −0.450371 | DIA4 | diaphorase (NADH/NADPH) (cytochrome b-5 reductase) |
| NM_001797 | −0.449862 | CDH11 | cadherin 11, type 2, OB-cadherin (osteoblast) |
| NM_014878 | 0.449818 | KIAA0020 | KIAA0020 gene product |
| NM_002742 | −0.449590 | PRKCM | protein kinase C, mu |

TABLE 5

231 gene markers that distinguish patients with good prognosis from patients with poor prognosis.

| GenBank Accession Number | SEQ ID NO |
|---|---|
| AA555029_RC | SEQ ID NO 1 |
| AB020689 | SEQ ID NO 37 |
| AB032973 | SEQ ID NO 55 |
| AB033007 | SEQ ID NO 58 |
| AB033043 | SEQ ID NO 62 |
| AB037745 | SEQ ID NO 75 |
| AB037863 | SEQ ID NO 88 |
| AF052159 | SEQ ID NO 120 |
| AF052162 | SEQ ID NO 121 |
| AF055033 | SEQ ID NO 124 |
| AF073519 | SEQ ID NO 137 |
| AF148505 | SEQ ID NO 169 |
| AF155117 | SEQ ID NO 173 |
| AF161553 | SEQ ID NO 177 |
| AF201951 | SEQ ID NO 183 |
| AF257175 | SEQ ID NO 189 |
| AJ224741 | SEQ ID NO 196 |
| AK000745 | SEQ ID NO 219 |
| AL050021 | SEQ ID NO 257 |
| AL050090 | SEQ ID NO 259 |
| AL080059 | SEQ ID NO 270 |
| AL080079 | SEQ ID NO 271 |
| AL080110 | SEQ ID NO 272 |
| AL133603 | SEQ ID NO 306 |
| AL133619 | SEQ ID NO 307 |
| AL137295 | SEQ ID NO 315 |
| AL137502 | SEQ ID NO 326 |
| AL137514 | SEQ ID NO 327 |
| AL137718 | SEQ ID NO 336 |
| AL355708 | SEQ ID NO 353 |
| D25328 | SEQ ID NO 357 |
| L27560 | SEQ ID NO 390 |
| M21551 | SEQ ID NO 394 |
| NM_000017 | SEQ ID NO 416 |
| NM_000096 | SEQ ID NO 430 |
| NM_000127 | SEQ ID NO 436 |
| NM_000158 | SEQ ID NO 442 |
| NM_000224 | SEQ ID NO 453 |
| NM_000286 | SEQ ID NO 462 |
| NM_000291 | SEQ ID NO 463 |
| NM_000320 | SEQ ID NO 469 |
| NM_000436 | SEQ ID NO 487 |
| NM_000507 | SEQ ID NO 491 |
| NM_000599 | SEQ ID NO 503 |
| NM_000788 | SEQ ID NO 527 |
| NM_000849 | SEQ ID NO 530 |
| NM_001007 | SEQ ID NO 550 |
| NM_001124 | SEQ ID NO 562 |
| NM_001168 | SEQ ID NO 566 |
| NM_001216 | SEQ ID NO 574 |
| NM_001280 | SEQ ID NO 588 |
| NM_001282 | SEQ ID NO 589 |
| NM_001333 | SEQ ID NO 597 |
| NM_001673 | SEQ ID NO 645 |

TABLE 5-continued 231 gene markers that distinguish patients with good prognosis from patients with poor prognosis.

| GenBank Accession Number | SEQ ID NO |
| --- | --- |
| NM_001809 | SEQ ID NO 673 |
| NM_001827 | SEQ ID NO 676 |
| NM_001905 | SEQ ID NO 691 |
| NM_002019 | SEQ ID NO 711 |
| NM_002073 | SEQ ID NO 721 |
| NM_002358 | SEQ ID NO 764 |
| NM_002570 | SEQ ID NO 787 |
| NM_002808 | SEQ ID NO 822 |
| NM_002811 | SEQ ID NO 823 |
| NM_002900 | SEQ ID NO 835 |
| NM_002916 | SEQ ID NO 838 |
| NM_003158 | SEQ ID NO 881 |
| NM_003234 | SEQ ID NO 891 |
| NM_003239 | SEQ ID NO 893 |
| NM_003258 | SEQ ID NO 896 |
| NM_003376 | SEQ ID NO 906 |
| NM_003600 | SEQ ID NO 929 |
| NM_003607 | SEQ ID NO 930 |
| NM_003662 | SEQ ID NO 938 |
| NM_003676 | SEQ ID NO 941 |
| NM_003748 | SEQ ID NO 951 |
| NM_003862 | SEQ ID NO 960 |
| NM_003875 | SEQ ID NO 962 |
| NM_003878 | SEQ ID NO 963 |
| NM_003882 | SEQ ID NO 964 |
| NM_003981 | SEQ ID NO 977 |
| NM_004052 | SEQ ID NO 985 |
| NM_004163 | SEQ ID NO 995 |
| NM_004336 | SEQ ID NO 1022 |
| NM_004358 | SEQ ID NO 1026 |
| NM_004456 | SEQ ID NO 1043 |
| NM_004480 | SEQ ID NO 1046 |
| NM_004504 | SEQ ID NO 1051 |
| NM_004603 | SEQ ID NO 1064 |
| NM_004701 | SEQ ID NO 1075 |
| NM_004702 | SEQ ID NO 1076 |
| NM_004798 | SEQ ID NO 1087 |
| NM_004911 | SEQ ID NO 1102 |
| NM_004994 | SEQ ID NO 1108 |
| NM_005196 | SEQ ID NO 1127 |
| NM_005342 | SEQ ID NO 1143 |
| NM_005496 | SEQ ID NO 1157 |
| NM_005563 | SEQ ID NO 1173 |
| NM_005915 | SEQ ID NO 1215 |
| NM_006096 | SEQ ID NO 1240 |
| NM_006101 | SEQ ID NO 1241 |
| NM_006115 | SEQ ID NO 1245 |
| NM_006117 | SEQ ID NO 1246 |
| NM_006201 | SEQ ID NO 1254 |
| NM_006265 | SEQ ID NO 1260 |
| NM_006281 | SEQ ID NO 1263 |
| NM_006372 | SEQ ID NO 1273 |
| NM_006681 | SEQ ID NO 1306 |
| NM_006763 | SEQ ID NO 1315 |
| NM_006931 | SEQ ID NO 1341 |
| NM_007036 | SEQ ID NO 1349 |
| NM_007203 | SEQ ID NO 1362 |
| NM_012177 | SEQ ID NO 1390 |
| NM_012214 | SEQ ID NO 1392 |
| NM_012261 | SEQ ID NO 1397 |
| NM_012429 | SEQ ID NO 1413 |
| NM_013262 | SEQ ID NO 1425 |
| NM_013296 | SEQ ID NO 1427 |
| NM_013437 | SEQ ID NO 1439 |
| NM_014078 | SEQ ID NO 1449 |
| NM_014109 | SEQ ID NO 1451 |
| NM_014321 | SEQ ID NO 1477 |
| NM_014363 | SEQ ID NO 1480 |
| NM_014750 | SEQ ID NO 1527 |
| NM_014754 | SEQ ID NO 1528 |
| NM_014791 | SEQ ID NO 1535 |
| NM_014875 | SEQ ID NO 1545 |
| NM_014889 | SEQ ID NO 1548 |
| NM_014968 | SEQ ID NO 1554 |
| NM_015416 | SEQ ID NO 1559 |
| NM_015417 | SEQ ID NO 1560 |
| NM_015434 | SEQ ID NO 1562 |
| NM_015984 | SEQ ID NO 1587 |
| NM_016337 | SEQ ID NO 1636 |
| NM_016359 | SEQ ID NO 1638 |
| NM_016448 | SEQ ID NO 1645 |
| NM_016569 | SEQ ID NO 1655 |
| NM_016577 | SEQ ID NO 1656 |
| NM_017779 | SEQ ID NO 1708 |
| NM_018004 | SEQ ID NO 1725 |
| NM_018098 | SEQ ID NO 1739 |
| NM_018104 | SEQ ID NO 1743 |
| NM_018120 | SEQ ID NO 1745 |
| NM_018136 | SEQ ID NO 1748 |
| NM_018265 | SEQ ID NO 1766 |
| NM_018354 | SEQ ID NO 1774 |
| NM_018401 | SEQ ID NO 1782 |
| NM_018410 | SEQ ID NO 1783 |
| NM_018454 | SEQ ID NO 1786 |
| NM_018455 | SEQ ID NO 1787 |
| NM_019013 | SEQ ID NO 18O9 |
| NM_020166 | SEQ ID NO 1825 |
| NM_020188 | SEQ ID NO 1830 |
| NM_020244 | SEQ ID NO 1835 |
| NM_020386 | SEQ ID NO 1838 |
| NM_020675 | SEQ ID NO 1842 |
| NM_020974 | SEQ ID NO 1844 |
| R70506_RC | SEQ ID NO 1868 |
| U45975 | SEQ ID NO 1878 |
| U58033 | SEQ ID NO 1881 |
| U82987 | SEQ ID NO 1891 |
| U96131 | SEQ ID NO 1896 |
| X05610 | SEQ ID NO 1903 |
| X94232 | SEQ ID NO 1927 |
| Contig753_RC | SEQ ID NO 1954 |
| Contig1778_RC | SEQ ID NO 1979 |
| Contig2399_RC | SEQ ID NO 1989 |
| Contig2504_RC | SEQ ID NO 1991 |
| Contig3902_RC | SEQ ID NO 2017 |
| Contig4595 | SEQ ID NO 2022 |
| Contig8581_RC | SEQ ID NO 2037 |
| Contig13480_RC | SEQ ID NO 2052 |
| Contig17359_RC | SEQ ID NO 2068 |
| Contig20217_RC | SEQ ID NO 2072 |
| Contig21812_RC | SEQ ID NO 2082 |
| Contig24252_RC | SEQ ID NO 2087 |
| Contig25055_RC | SEQ ID NO 2090 |
| Contig25343_RC | SEQ ID NO 2092 |
| Contig25991 | SEQ ID NO 2098 |
| Contig27312_RC | SEQ ID NO 2108 |
| Contig28552_RC | SEQ ID NO 2120 |
| Contig32125_RC | SEQ ID NO 2155 |
| Contig32185_RC | SEQ ID NO 2156 |
| Contig33814_RC | SEQ ID NO 2169 |
| Contig34634_RC | SEQ ID NO 2180 |
| Contig35251_RC | SEQ ID NO 2185 |
| Contig37063_RC | SEQ ID NO 2206 |
| Contig37598 | SEQ ID NO 2216 |
| Contig38288_RC | SEQ ID NO 2223 |
| Contig40128_RC | SEQ ID NO 2248 |
| Contig40831_RC | SEQ ID NO 2260 |

TABLE 5-continued 231 gene markers that distinguish patients with good prognosis from patients with poor prognosis.

| GenBank Accession Number | SEQ ID NO |
|---|---|
| Contig41413_RC | SEQ ID NO 2266 |
| Contig41887_RC | SEQ ID NO 2276 |
| Contig42421_RC | SEQ ID NO 2291 |
| Contig43747_RC | SEQ ID NO 2311 |
| Contig44064_RC | SEQ ID NO 2315 |
| Contig44289_RC | SEQ ID NO 2320 |
| Contig44799_RC | SEQ ID NO 2330 |
| Contig45347_RC | SEQ ID NO 2344 |
| Contig45816_RC | SEQ ID NO 2351 |
| Contig46218_RC | SEQ ID NO 2358 |
| Contig46223_RC | SEQ ID NO 2359 |
| Contig46653_RC | SEQ ID NO 2369 |
| Contig46802_RC | SEQ ID NO 2372 |
| Contig47405_RC | SEQ ID NO 2384 |
| Contig48328_RC | SEQ ID NO 2400 |
| Contig49670_RC | SEQ ID NO 2434 |
| Contig50106_RC | SEQ ID NO 2445 |
| Contig50410 | SEQ ID NO 2453 |
| Contig50802_RC | SEQ ID NO 2463 |
| Contig51464_RC | SEQ ID NO 2481 |
| Contig51519_RC | SEQ ID NO 2482 |
| Contig51749_RC | SEQ ID NO 2486 |
| Contig51963 | SEQ ID NO 2494 |
| Contig53226_RC | SEQ ID NO 2525 |
| Contig53268_RC | SEQ ID NO 2529 |
| Contig53646_RC | SEQ ID NO 2538 |
| Contig53742_RC | SEQ ID NO 2542 |
| Contig55188_RC | SEQ ID NO 2586 |
| Contig55313_RC | SEQ ID NO 2590 |
| Contig55377_RC | SEQ ID NO 2591 |
| Contig55725_RC | SEQ ID NO 2600 |
| Contig55813_RC | SEQ ID NO 2607 |
| Contig55829_RC | SEQ ID NO 2608 |
| Contig56457_RC | SEQ ID NO 2630 |
| Contig57595 | SEQ ID NO 2655 |
| Contig57864_RC | SEQ ID NO 2663 |
| Contig58368_RC | SEQ ID NO 2668 |
| Contig60864_RC | SEQ ID NO 2676 |
| Contig63102_RC | SEQ ID NO 2684 |
| Contig63649_RC | SEQ ID NO 2686 |
| Contig64688 | SEQ ID NO 2690 |

TABLE 6

70 Preferred prognosis markers drawn from Table 5.

| Identifier | Correlation | Sequence Name | Description |
|---|---|---|---|
| AL080059 | −0.527150 | | *Homo sapiens* mRNA for KIAA1750 protein, partial cds |
| Contig63649_RC | −0.468130 | | ESTs |
| Contig46218_RC | −0.432540 | | ESTs |
| NM_016359 | −0.424930 | LOC51203 | clone HQ0310 PRO0310p1 |
| AA555029_RC | −0.424120 | | ESTs |
| NM_003748 | 0.420671 | ALDH4 | aldehyde dehydrogenase 4 (glutamate gamma-semialdehyde dehydrogenase; pyrroline-5-carboxylate dehydrogenase) |
| Contig38288_RC | −0.414970 | | ESTs, Weakly similar to ISHUSS protein disulfide-isomerase [*H. sapiens*] |
| NM_003862 | 0.410964 | FGF18 | fibroblast growth factor 18 |
| Contig28552_RC | −0.409260 | | *Homo sapiens* mRNA; cDNA DKFZp434C0931 (from clone DKFZp434C0931); partial cds |
| Contig32125_RC | 0.409054 | | ESTs |
| U82987 | 0.407002 | BBC3 | Bcl-2 binding component 3 |
| AL137718 | −0.404980 | | *Homo sapiens* mRNA; cDNA DKFZp434C0931 (from clone DKFZp434C0931); partial cds |
| AB037863 | 0.402335 | KIAA1442 | KIAA1442 protein |
| NM_020188 | −0.400070 | DC13 | DC13 protein |
| NM_020974 | 0.399987 | CEGP1 | CEGP1 protein |

TABLE 6-continued

70 Preferred prognosis markers drawn from Table 5.

| Identifier | Correlation | Sequence Name | Description |
|---|---|---|---|
| NM_000127 | −0.399520 | EXT1 | exostoses (multiple) 1 |
| NM_002019 | −0.398070 | FLT1 | fms-related tyrosine kinase 1 (vascular endothelial growth factor/vascular permeability factor receptor) |
| NM_002073 | −0.395460 | GNAZ | guanine nucleotide binding protein (G protein), alpha z polypeptide |
| NM_000436 | −0.392120 | OXCT | 3-oxoacid CoA transferase |
| NM_004994 | −0.391690 | MMP9 | matrix metalloproteinase 9 (gelatinase B, 92 kD gelatinase, 92 kD type IV collagenase) |
| Contig55377_RC | 0.390600 | | ESTs |
| Contig35251_RC | −0.390410 | | *Homo sapiens* cDNA: FLJ22719 fis, clone HSI14307 |
| Contig25991 | −0.390370 | ECT2 | epithelial cell transforming sequence 2 oncogene |
| NM_003875 | −0.386520 | GMPS | guanine monphosphate synthetase |
| NM_006101 | −0.385890 | HEC | highly expressed in cancer, rich in leucine heptad repeats |
| NM_003882 | 0.384479 | WISP1 | WNT1 inducible signaling pathway protein 1 |
| NM_003607 | −0.384390 | PK428 | Ser-Thr protein kinase related to the myotonic dystrophy protein kinase |
| AF073519 | −0.383340 | SERF1A | small EDRK-rich factor 1A (telomeric) |
| AF052162 | −0.380830 | FLJ12443 | hypothetical protein FLJ12443 |
| NM_000849 | 0.380831 | GSTM3 | glutathione S-transferase M3 (brain) |
| Contig32185_RC | −0.379170 | | *Homo sapiens* cDNA FLJ13997 fis, clone Y79AA1002220 |
| NM_016577 | −0.376230 | RAB6B | RAB6B, member RAS oncogene family |
| Contig48328_RC | 0.375252 | | ESTs, Weakly similar to T17248 hypothetical protein DKFZp586G1122.1 [*H. sapiens*] |
| Contig46223_RC | 0.374289 | | ESTs |
| NM_015984 | −0.373880 | UCH37 | ubiquitin C-terminal hydrolase UCH37 |
| NM_006117 | 0.373290 | PECI | peroxisomal D3,D2-enoyl-CoA isomerase |
| AK000745 | −0.373060 | | *Homo sapiens* cDNA FLJ20738 fis, clone HEP08257 |
| Contig40831_RC | −0.372930 | | ESTs |
| NM_003239 | 0.371524 | TGFB3 | transforming growth factor, beta 3 |
| NM_014791 | −0.370860 | KIAA0175 | KIAA0175 gene product |
| X05610 | −0.370860 | COL4A2 | collagen, type IV, alpha 2 |
| NM_016448 | −0.369420 | L2DTL | L2DTL protein |
| NM_018401 | 0.368349 | HSA250839 | gene for serine/threonine protein kinase |
| NM_000788 | −0.367700 | DCK | deoxycytidine kinase |
| Contig51464_RC | −0.367450 | FLJ22477 | hypothetical protein FLJ22477 |
| AL080079 | −0.367390 | DKFZP564D0462 | hypothetical protein DKFZp564D0462 |
| NM_006931 | −0.366490 | SLC2A3 | solute carrier family 2 (facilitated glucose transporter), member 3 |
| AF257175 | 0.365900 | | *Homo sapiens* hepatocellular carcinoma-associated antigen 64 (HCA64) mRNA, complete cds |
| NM_014321 | −0.365810 | ORC6L | origin recognition complex, subunit 6 (yeast homolog)-like |
| NM_002916 | −0.365590 | RFC4 | replication factor C (activator 1) 4 (37 kD) |
| Contig55725_RC | −0.365350 | | ESTs, Moderately similar to T50635 hypothetical protein DKFZp762L0311.1 [*H. sapiens*] |
| Contig24252_RC | −0.364990 | | ESTs |
| AF201951 | 0.363953 | CFFM4 | high affinity immunoglobulin epsilon receptor beta subunit |
| NM_005915 | −0.363850 | MCM6 | minichromosome maintenance deficient (mis5, *S. pombe*) 6 |
| NM_001282 | 0.363326 | AP2B1 | adaptor-related protein complex 2, beta 1 subunit |
| Contig56457_RC | −0.361650 | TMEFF1 | transmembrane protein with EGF-like and two follistatin-like domains 1 |

TABLE 6-continued

70 Preferred prognosis markers drawn from Table 5.

| Identifier | Correlation | Sequence Name | Description |
|---|---|---|---|
| NM_000599 | −0.361290 | IGFBP5 | insulin-like growth factor binding protein 5 |
| NM_020386 | −0.360780 | LOC57110 | H-REV107 protein-related protein |
| NM_014889 | −0.360040 | MP1 | metalloprotease 1 (pitrilysin family) |
| AF055033 | −0.359940 | IGFBP5 | insulin-like growth factor binding protein 5 |
| NM_006681 | −0.359700 | NMU | neuromedin U |
| NM_007203 | −0.359570 | AKAP2 | A kinase (PRKA) anchor protein 2 |
| Contig63102_RC | 0.359255 | FLJ11354 | hypothetical protein FLJ11354 |
| NM_003981 | −0.358260 | PRC1 | protein regulator of cytokinesis 1 |
| Contig20217_RC | −0.357880 | | ESTs |
| NM_001809 | −0.357720 | CENPA | centromere protein A (17 kD) |
| Contig2399_RC | −0.356600 | SM-20 | similar to rat smooth muscle protein SM-20 |
| NM_004702 | −0.356600 | CCNE2 | cyclin E2 |
| NM_007036 | −0.356540 | ESM1 | endothelial cell-specific molecule 1 |
| NM_018354 | −0.356000 | FLJ11190 | hypothetical protein FLJ11190 |

TABLE 7

Good and poor prognosis templates: mean subtracted log(intensity) values for each of the seventy markers listed in Table 6 for 44 breast cancer patients having a good prognosis (C1) or 34 breast cancer patients having a poor prognosis (C2) (see Examples).

| Marker Accession # | C1 (good prognosis template) | C2 (poor prognosis template) |
|---|---|---|
| AL080059 | −5.161569 | 0.043019 |
| Contig63649_RC | −1.440895 | 0.966702 |
| Contig46218_RC | −0.937662 | 0.815081 |
| NM_016359 | −1.49878 | 0.872829 |
| AA555029_RC | −1.283504 | 0.543442 |
| NM_003748 | 1.355486 | −0.254201 |
| Contig38288_RC | −1.237495 | 1.085461 |
| NM_003862 | 0.981236 | −1.619658 |
| Contig28552_RC | −1.296043 | 1.067545 |
| Contig32125_RC | 0.855155 | −0.7338 |
| U82987 | 1.256206 | −1.362807 |
| AL137718 | −0.55046 | 0.68754 |
| AB037863 | 0.819061 | −1.621057 |
| NM_020188 | −1.137582 | 0.673123 |
| NM_020974 | −0.463953 | −5.623268 |
| NM_000127 | −0.618568 | 0.552726 |
| NM_002019 | −1.409168 | 0.547285 |
| NM_002073 | −1.577177 | 0.417352 |
| NM_000436 | −0.722574 | 0.599239 |
| NM_004994 | −5.561089 | −2.180659 |
| Contig55377_RC | 0.805683 | −1.16728 |
| Contig35251_RC | −0.931146 | 0.607562 |
| Contig25991 | −0.720727 | 1.045949 |
| NM_003875 | −1.206839 | 1.163244 |
| NM_006101 | −0.879965 | 0.628296 |
| NM_003882 | 0.529121 | −0.467098 |
| NM_003607 | −0.959094 | 0.709653 |
| AF073519 | −1.451486 | 0.163988 |
| AF052162 | −1.145575 | 0.192391 |
| NM_000849 | 0.944742 | −1.499473 |
| Contig32185_RC | −0.887643 | 0.688257 |
| NM_016577 | −2.762008 | 0.081637 |
| Contig48328_RC | 0.405401 | −2.946904 |
| Contig46223_RC | 0.805424 | −0.581849 |
| NM_015984 | −1.056531 | 0.522176 |
| NM_006117 | 1.129928 | −1.262974 |
| AK000745 | −2.475715 | −0.013002 |
| Contig40831_RC | −1.17091 | 0.435754 |
| NM_003239 | 0.457773 | −2.150499 |
| NM_014791 | −1.14862 | 0.383018 |
| X05610 | −0.768514 | 0.637938 |
| NM_016448 | −0.713264 | 0.632638 |
| NM_018401 | 0.618921 | −0.286778 |
| NM_000788 | −0.995116 | 0.50246 |
| Contig51464_RC | −0.663538 | 0.765975 |
| AL080079 | −1.794821 | 0.43708 |
| NM_006931 | −0.846271 | 0.915602 |
| AF257175 | 1.122354 | −0.721924 |
| NM_014321 | −1.820261 | 0.482287 |
| NM_002916 | −0.966852 | 0.599925 |
| Contig55725_RC | −2.935162 | 0.623397 |
| Contig24252_RC | −2.004671 | 0.263597 |
| AF201951 | 0.355839 | −2.296556 |
| NM_005915 | −0.586121 | 0.827714 |
| NM_001282 | 0.762645 | −0.970421 |
| Contig56457_RC | −0.920808 | 0.588269 |
| NM_000599 | −3.612469 | −0.714313 |
| NM_020386 | −0.46073 | 0.699313 |
| NM_014889 | −1.678462 | 0.2362 |
| AF055033 | −2.505271 | −0.07576 |
| NM_006681 | −0.631302 | 0.584119 |
| NM_007203 | −1.426446 | 0.504624 |
| Contig63102_RC | 0.521511 | −1.266163 |
| NM_003981 | −2.521877 | 0.552669 |
| Contig20217_RC | −0.363574 | 0.449022 |
| NM_001809 | −2.171301 | 0.328419 |
| Contig2399_RC | −1.174844 | 0.602523 |
| NM_004702 | −1.560133 | 0.619078 |
| NM_007036 | −0.950633 | 0.34945 |
| NM_018354 | −1.392354 | 0.347831 |

The sets of markers listed in Tables 1–6 partially overlap; in other words, some markers are present in multiple sets, while other markers are unique to a set (FIG. 1). Thus, in one embodiment, the invention provides a set of 256 genetic markers that can distinguish between ER(+) and ER(−), and also between BRCA1 tumors and sporadic tumors (i.e., classify a tumor as ER(−) or ER(−) and BRCA1-related or sporadic). In a more specific embodiment, the invention provides subsets of at least 20, at least 50, at least 100, or at least 150 of the set of 256 markers, that can classify a tumor as ER(−) or ER(−) and BRCA1-related or sporadic. In another embodiment, the invention provides 165 markers that can distinguish between ER(+) and ER(−), and also between patients with good versus poor prognosis (i.e., classify a tumor as either ER(−) or ER(+) and as having been removed from a patient with a good prognosis or a poor prognosis). In a more specific embodiment, the invention further provides subsets of at least 20, 50, 100 or 125 of the full set of 165 markers, which also classify a tumor as either ER(−) or ER(+) and as having been removed from a patient with a good prognosis or a poor prognosis The invention further provides a set of twelve markers that can distinguish between BRCA1 tumors and sporadic tumors, and between patients with good versus poor prognosis. Finally, the invention provides eleven markers capable of differentiating all three statuses. Conversely, the invention provides 2,050 of the 2,460 ER-status markers that can determine only ER status, 173 of the 430 BRCA1 v. sporadic markers that can determine only BRCA1 v. sporadic status, and 65 of the 231 prognosis markers that can only determine prognosis. In more specific embodiments, the invention also provides for subsets of at least 20, 50, 100, 200, 500, 1,000, 1,500 or 2,000 of the 2,050 ER-status markers that also determine only ER status. The invention also provides subsets of at least 20, 50, 100 or 150 of the 173 markers that also determine only BRCA1 v. sporadic status. The invention further provides subsets of at least 20, 30, 40, or 50 of the 65 prognostic markers that also determine only prognostic status.

Any of the sets of markers provided above may be used alone specifically or in combination with markers outside the set. For example, markers that distinguish ER-status may be used in combination with the BRCA1 vs. sporadic markers, or with the prognostic markers, or both. Any of the marker sets provided above may also be used in combination with other markers for breast cancer, or for any other clinical or physiological condition.

The relationship between the marker sets is diagramed in FIG. 1.

5.3.2 Identification of Markers

The present invention provides sets of markers for the identification of conditions or indications associated with breast cancer. Generally, the marker sets were identified by determining which of ~25,000 human markers had expression patters that correlated with the conditions or indications.

In one embodiment, the method for identifying marker sets is as follows. After extraction and labeling of target polynucleotides, the expression of all markers (genes) in a sample X is compared to the expression of all markers in a standard or control. In one embodiment, the standard or control comprises target polynucleotide molecules derived from a sample from a normal individual (i.e., an individual not afflicted with breast cancer). In a preferred embodiment, the standard or control is a pool of target polynucleotide molecules. The pool may derived from collected samples from a number of normal individuals. In a preferred embodiment, the pool comprises samples taken from a number of individuals having sporadic-type tumors. In another preferred embodiment, the pool comprises an artificially-generated population of nucleic acids designed to approximate the level of nucleic acid derived from each marker found in a pool of marker-derived nucleic acids derived from tumor samples. In yet another embodiment, the pool is derived from normal or breast cancer cell lines or cell line samples.

The comparison may be accomplished by any means known in the art. For example, expression levels of various markers may be assessed by separation of target polynucleotide molecules (e.g., RNA or cDNA) derived from the markers in agarose or polyacrylamide gels, followed by hybridization with marker-specific oligonucleotide probes. Alternatively, the comparison may be accomplished by the labeling of target polynucleotide molecules followed by separation on a sequencing gel. Polynucleotide samples are placed on the gel such that patient and control or standard polynucleotides are in adjacent lanes. Comparison of expression levels is accomplished visually or by means of densitometer. In a preferred embodiment, the expression of all markers is assessed simultaneously by hybridization to a microarray. In each approach, markers meeting certain criteria are identified as associated with breast cancer.

A marker is selected based upon significant difference of expression in a sample as compared to a standard or control condition. Selection may be made based upon either significant up- or down regulation of the marker in the patient sample. Selection may also be made by calculation of the statistical significance (i.e., the p-value) of the correlation between the expression of the marker and the condition or indication. Preferably, both selection criteria are used. Thus, in one embodiment of the present invention, markers associated with breast cancer are selected where the markers show both more than two-fold change (increase or decrease) in expression as compared to a standard, and the p-value for the correlation between the existence of breast cancer and the change in marker expression is no more than 0.01 (i.e., is statistically significant).

The expression of the identified breast cancer-related markers is then used to identify markers that can differentiate tumors into clinical types. In a specific embodiment using a number of tumor samples, markers are identified by calculation of correlation coefficients between the clinical category or clinical parameter(s) and the linear, logarithmic or any transform of the expression ratio across all samples for each individual gene. Specifically, the correlation coefficient is calculated as $$\rho = (\vec{c} \cdot \vec{r})/(\|\vec{c}\| \cdot \|\vec{r}\|) \qquad \text{Equation (2)}$$

where $\vec{c}$ represents the clinical parameters or categories and $\vec{r}$ represents the linear, logarithmic or any transform of the ratio of expression between sample and control. Markers for which the coefficient of correlation exceeds a cutoff are identified as breast cancer-related markers specific for a particular clinical type. Such a cutoff or threshold corresponds to a certain significance of discriminating genes obtained by Monte Carlo simulations. The threshold depends upon the number of samples used; the threshold can be calculated as $3 \times 1/\sqrt{n-3}$, where $1/\sqrt{n-3}$ is the distribution width and n=the number of samples. In a specific embodiment, markers are chosen if the correlation coefficient is greater than about 0.3 or less than about −0.3.

Next, the significance of the correlation is calculated. This significance may be calculated by any statistical means by which such significance is calculated. In a specific example, a set of correlation data is generated using a Monte-Carlo technique to randomize the association between the expression difference of a particular marker and the clinical category. The frequency distribution of markers satisfying the criteria through calculation of correlation coefficients is compared to the number of markers satisfying the criteria in the data generated through the Monte-Carlo technique. The frequency distribution of markers satisfying the criteria in the Monte-Carlo runs is used to determine whether the number of markers selected by correlation with clinical data is significant. See Example 4.

Once a marker set is identified, the markers may be rank-ordered in order of significance of discrimination. One means of rank ordering is by the amplitude of correlation between the change in gene expression of the marker and the specific condition being discriminated. Another, preferred, means is to use a statistical metric. In a specific embodiment, the metric is a Fisher-like statistic:

$$t = (<x_1> - <x_2>)/\sqrt{[\sigma_1^2(n_1-1) + \sigma_2^2(n_2-1)]/(n_1+n_2-1)(1/n_1+1/n_2)}$$ Equation (3)

In this equation, $<x_1>$ is the error-weighted average of the log ratio of transcript expression measurements within a first diagnostic group (e.g., ER(−), $<x_2>$ is the error-weighted average of log ratio within a second, related diagnostic group (e.g., ER(+)), $\sigma_1$ is the variance of the log ratio within the ER(−) group and $n_1$ is the number of samples for which valid measurements of log ratios are available. $\sigma_2$ is the variance of log ratio within the second diagnostic group (e.g., ER(+)), and $n_2$ is the number of samples for which valid measurements of log ratios are available. The t-value represents the variance-compensated difference between two means.

The rank-ordered marker set may be used to optimize the number of markers in the set used for discrimination. This is accomplished generally in a "leave one out" method as follows. In a first run, a subset, for example 5, of the markers from the top of the ranked list is used to generate a template, where out of X samples, X-1 are used to generate the template, and the status of the remaining sample is predicted. This process is repeated for every sample until every one of the X samples is predicted once. In a second run, additional markers, for example 5, are added, so that a template is now generated from 10 markers, and the outcome of the remaining sample is predicted. This process is repeated until the entire set of markers is used to generate the template. For each of the runs, type 1 error (false negative) and type 2 errors (false positive) are counted; the optimal number of markers is that number where the type 1 error rate, or type 2 error rate, or preferably the total of type 1 and type 2 error rate is lowest.

For prognostic markers, validation of the marker set may be accomplished by an additional statistic, a survival model. This statistic generates the probability of tumor distant metastases as a function of time since initial diagnosis. A number of models may be used, including Weibull, normal, log-normal, log logistic, log-exponential, or log-Rayleigh (Chapter 12 "Life Testing", S-PLUS 2000 GUIDE TO STATISTICS, Vol. 2, p. 368 (2000)). For the "normal" model, the probability of distant metastases P at time t is calculated as $$P = \alpha \times \exp(-t^2/\tau^2)$$ Equation (4)

where $\alpha$ is fixed and equal to 1, and $\tau$ is a parameter to be fitted and measures the "expected lifetime".

It will be apparent to those skilled in the art that the above methods, in particular the statistical methods, described above, are not limited to the identification of markers associated with breast cancer, but may be used to identify set of marker genes associated with any phenotype. The phenotype can be the presence or absence of a disease such as cancer, or the presence or absence of any identifying clinical condition associated with that cancer. In the disease context, the phenotype may be a prognosis such as a survival time, probability of distant metastases of a disease condition, or likelihood of a particular response to a therapeutic or prophylactic regimen. The phenotype need not be cancer, or a disease; the phenotype may be a nominal characteristic associated with a healthy individual.

5.3.3 Sample Collection

In the present invention, target polynucleotide molecules are extracted from a sample taken from an individual afflicted with breast cancer. The sample may be collected in any clinically acceptable manner, but must be collected such that marker-derived polynucleotides (i.e., RNA) are preserved. mRNA or nucleic acids derived therefrom (i.e., cDNA or amplified DNA) are preferably labeled distinguishably from standard or control polynucleotide molecules, and both are simultaneously or independently hybridized to a microarray comprising some or all of the markers or marker sets or subsets described above. Alternatively, mRNA or nucleic acids derived therefrom may be labeled with the same label as the standard or control polynucleotide molecules, wherein the intensity of hybridization of each at a particular probe is compared. A sample may comprise any clinically relevant tissue sample, such as a tumor biopsy or fine needle aspirate, or a sample of bodily fluid, such as blood, plasma, serum, lymph, ascitic fluid, cystic fluid, urine or nipple exudate. The sample may be taken from a human, or, in a veterinary context, from non-human animals such as ruminants, horses, swine or sheep, or from domestic companion animals such as felines and canines.

Methods for preparing total and poly(A)+RNA are well known and are described generally in Sambrook et al., MOLECULAR CLONING—A LABORATORY MANUAL (2ND ED.), Vols. 1–3, Cold Spring Harbor Laboratory, Cold Spring Harbor, N.Y. (1989)) and Ausubel et al., CURRENT PROTOCOLS IN MOLECULAR BIOLOGY, vol. 2, Current Protocols Publishing, New York (1994)).

RNA may be isolated from eukaryotic cells by procedures that involve lysis of the cells and denaturation of the proteins contained therein. Cells of interest include wild-type cells (i.e., non-cancerous), drug-exposed wild-type cells, tumor- or tumor-derived cells, modified cells, normal or tumor cell line cells, and drug-exposed modified cells.

Additional steps may be employed to remove DNA. Cell lysis may be accomplished with a nonionic detergent, followed by microcentrifugation to remove the nuclei and hence the bulk of the cellular DNA. In one embodiment, RNA is extracted from cells of the various types of interest using guanidinium thiocyanate lysis followed by CsCl centrifugation to separate the RNA from DNA (Chirgwin et al., Biochemistry 18:5294–5299 (1979)). Poly(A)+RNA is selected by selection with oligo-dT cellulose (see Sambrook et al., MOLECULAR CLONING—A LABORATORY MANUAL (2ND ED.), Vols. 1–3, Cold Spring Harbor Laboratory, Cold Spring Harbor, N.Y. (1989). Alternatively, separation of RNA from DNA can be accomplished by organic extraction, for example, with hot phenol or phenol/chloroform/isoamyl alcohol.

If desired, RNAse inhibitors may be added to the lysis buffer. Likewise, for certain cell types, it may be desirable to add a protein denaturation/digestion step to the protocol.

For many applications, it is desirable to preferentially enrich mRNA with respect to other cellular RNAs, such as transfer RNA (tRNA) and ribosomal RNA (rRNA). Most mRNAs contain a poly(A) tail at their 3' end. This allows them to be enriched by affinity chromatography, for example, using oligo(dT) or poly(U) coupled to a solid support, such as cellulose or SEPHADEX® medium (see Ausubel et al., CURRENT PROTOCOLS IN MOLECULAR BIOLOGY, vol. 2, Current Protocols Publishing, New York (1994). Once bound, poly(A)+mRNA is eluted from the affinity column using 2 mM EDTA/0.1% SDS.

The sample of RNA can comprise a plurality of different mRNA molecules, each different mRNA molecule having a different nucleotide sequence. In a specific embodiment, the mRNA molecules in the RNA sample comprise at least 100 different nucleotide sequences. More preferably, the mRNA molecules of the RNA sample comprise mRNA molecules corresponding to each of the marker genes. In another specific embodiment, the RNA sample is a mammalian RNA sample.

In a specific embodiment, total RNA or mRNA from cells are used in the methods of the invention. The source of the RNA can be cells of a plant or animal, human, mammal, primate, non-human animal, dog, cat, mouse, rat, bird, yeast, eukaryote, prokaryote, etc. In specific embodiments, the method of the invention is used with a sample containing total mRNA or total RNA from $1 \times 10^6$ cells or less. In another embodiment, proteins can be isolated from the foregoing sources, by methods known in the art, for use in expression analysis at the protein level.

Probes to the homologs of the marker sequences disclosed herein can be employed preferably wherein non-human nucleic acid is being assayed.

5.4 Methods of Using Breast Cancer Marker Sets

5.4.1 Diagnostic Methods

The present invention provides for methods of using the marker sets to analyze a sample from an individual so as to determine the individual's tumor type or subtype at a molecular level, whether a tumor is of the ER(+) or ER(-) type, and whether the tumor is BRCA1-associated or sporadic. The individual need not actually be afflicted with breast cancer. Essentially, the expression of specific marker genes in the individual, or a sample taken therefrom, is compared to a standard or control. For example, assume two breast cancer-related conditions, X and Y. One can compare the level of expression of breast cancer prognostic markers for condition X in an individual to the level of the marker-derived polynucleotides in a control, wherein the level represents the level of expression exhibited by samples having condition X. In this instance, if the expression of the markers in the individual's sample is substantially (i.e., statistically) different from that of the control, then the individual does not have condition X. Where, as here, the choice is bimodal (i.e., a sample is either X or Y), the individual can additionally be said to have condition Y. Of course, the comparison to a control representing condition Y can also be performed. Preferably both are performed simultaneously, such that each control acts as both a positive and a negative control. The distinguishing result may thus either be a demonstrable difference from the expression levels (i.e., the amount of marker-derived RNA, or polynucleotides derived therefrom) represented by the control, or no significant difference.

Thus, in one embodiment, the method of determining a particular tumor-related status of an individual comprises the steps of (1) hybridizing labeled target polynucleotides from an individual to a microarray containing one of the above marker sets; (2) hybridizing standard or control polynucleotides molecules to the microarray, wherein the standard or control molecules are differentially labeled from the target molecules; and (3) determining the difference in transcript levels, or lack thereof, between the target and standard or control, wherein the difference, or lack thereof, determines the individual's tumor-related status. In a more specific embodiment, the standard or control molecules comprise marker-derived polynucleotides from a pool of samples from normal individuals, or a pool of tumor samples from individuals having sporadic-type tumors. In a preferred embodiment, the standard or control is an artificially-generated pool of marker-derived polynucleotides, which pool is designed to mimic the level of marker expression exhibited by clinical samples of normal or breast cancer tumor tissue having a particular clinical indication (i.e., cancerous or non-cancerous; ER(+) or ER(-) tumor; BRCA1- or sporadic type tumor). In another specific embodiment, the control molecules comprise a pool derived from normal or breast cancer cell lines.

The present invention provides sets of markers useful for distinguishing ER(+) from ER(-) tumor types. Thus, in one embodiment of the above method, the level of polynucleotides (i.e., mRNA or polynucleotides derived therefrom) in a sample from an individual, expressed from the markers provided in Table 1 are compared to the level of expression of the same markers from a control, wherein the control comprises marker-related polynucleotides derived from ER(+) samples, ER(-) samples, or both. Preferably, the comparison is to both ER(+) and ER(-), and preferably the comparison is to polynucleotide pools from a number of ER(+) and ER(-) samples, respectively. Where the individual's marker expression most closely resembles or correlates with the ER(+) control, and does not resemble or correlate with the ER(-) control, the individual is classified as ER(+). Where the pool is not pure ER(+) or ER(-), for example, a sporadic pool is used. A set of experiments should be performed in which nucleic acids from individuals with known ER status are hybridized against the pool, in order to define the expression templates for the ER(+) and ER(-) group. Nucleic acids from each individual with unknown ER status are hybridized against the same pool and the expression profile is compared to the templates (s) to determine the individual's ER status.

The present invention provides sets of markers useful for distinguishing BRCA1-related tumors from sporadic tumors. Thus, the method can be performed substantially as for the ER(+/-) determination, with the exception that the markers are those listed in Tables 3 and 4, and the control markers are a pool of marker-derived polynucleotides BRCA1 tumor samples, and a pool of marker-derived polynucleotides from sporadic tumors. A patient is determined to have a BRCA1 germline mutation where the expression of the individual's marker-derived polynucleotides most closely resemble, or are most closely correlated with, that of the BRCA1 control. Where the control is not pure BRCA1 or sporadic, two templates can be defined in a manner similar to that for ER status, as described above.

For the above two embodiments of the method, the full set of markers may be used (i.e., the complete set of markers for Tables 1 or 3). In other embodiments, subsets of the markers may be used. In a preferred embodiment, the preferred markers listed in Tables 2 or 4 are used.

The similarity between the marker expression profile of an individual and that of a control can be assessed a number of ways. In the simplest case, the profiles can be compared visually in a printout of expression difference data. Alternatively, the similarity can be calculated mathematically.

In one embodiment, the similarity between two patients x and y, or patient x and a template y, expressed as a similarity value, can be calculated using the following equation:

$$S = 1 - \left[ \sum_{i=1}^{N_V} \frac{(x_i - \bar{x})}{\sigma_{x_i}} \frac{(y_i - \bar{y})}{\sigma_{y_i}} \bigg/ \sqrt{\sum_{i=1}^{N_V} \left(\frac{x_i - \bar{x}}{\sigma_{x_i}}\right)^2 \sum_{i=1}^{N_V} \left(\frac{y_i - \bar{y}}{\sigma_{y_i}}\right)^2} \right] \quad \text{Equation (5)}$$

In this equation, x and y are two patients with components of log ratio $x_i$ and $y_i$, i=1 . . . , N=4,986. Associated with every value $x_i$ is error $\sigma_{x_i}$. The smaller the value $\sigma_{x_o}$, the more reliable the measurement $$x_i \cdot \bar{x} = \sum_{i=1}^{N_V} \frac{x_i}{\sigma_{x_i}^2} \bigg/ \sum_{i=1}^{N_V} \frac{1}{\sigma_{x_i}^2}$$

is the error-weighted arithmetic mean.

In a preferred embodiment, templates are developed for sample comparison. The template is defined as the error-weighted log ratio average of the expression difference for the group of marker genes able to differentiate the particular breast cancer-related condition. For example, templates are defined for ER(+) samples and for ER(−) samples. Next, a classifier parameter is calculated. This parameter may be calculated using either expression level differences between the sample and template, or by calculation of a correlation coefficient. Such a coefficient, $P_i$, can be calculated using the following equation:

$$P_i = (\vec{z}_i \cdot \vec{y})/(\|\vec{z}_i\| \cdot \|\vec{y}\|) \quad \text{Equation (1)}$$

where $z_i$ is the expression template i, and y is the expression profile of a patient.

Thus, in a more specific embodiment, the above method of determining a particular tumor-related status of an individual comprises the steps of (1) hybridizing labeled target polynucleotides from an individual to a microarray containing one of the above marker sets; (2) hybridizing standard or control polynucleotides molecules to the microarray, wherein the standard or control molecules are differentially labeled from the target molecules; and (3) determining the ratio (or difference) of transcript levels between two channels (individual and control), or simply the transcript levels of the individual; and (4) comparing the results from (3) to the predefined templates, wherein said determining is accomplished by means of the statistic of Equation 1 or Equation 5, and wherein the difference, or lack thereof, determines the individual's tumor-related status.

5.4.2 Prognostic Methods

The present invention provides sets of markers useful for classifying patients with into different prognostic categories. For example, the invention further provides a method for using these markers to determine whether an individual afflicted with breast cancer will have a good or poor clinical prognosis. The present invention further provides a method of further classifying "good prognosis" patients into two groups: those having a "very good prognosis" and those having an "intermediate prognosis." For each of the above classifications, the invention further provides recommended therapeutic regimens.

The method can use the complete set of markers listed in Table 5. However, subsets of the markers listed in Table 5 may also be used. In a preferred embodiment, the subset of 70 markers listed in Table 6 is used. At least 5, 10, 15, 20, 25, 30, 40, 50, 60, or all 70 of the markers in Table 6 may be used.

Classification of a sample as "good prognosis" or "poor prognosis" is accomplished substantially as for the diagnostic markers described above, wherein a template is generated to which the marker expression levels in the sample are compared.

Thus, in one embodiment of the above method, the level of polynucleotides (i.e., mRNA or polynucleotides derived therefrom) in a sample from an individual breast cancer patient, expressed from the markers provided in Table 5, is compared to the level of expression of the same markers from a control, wherein the control comprises marker-related polynucleotides derived from breast cancer tumor samples taken from breast cancer patients clinically determined to have a good prognosis ("good prognosis" control), breast cancer patients clinically determined to have a poor prognosis ("poor prognosis" control), or both. The comparison may be to both good prognosis and poor prognosis controls, and preferably the comparison is to polynucleotide pools from a number of good prognosis and poor prognosis samples, respectively. Where the individual's marker expression most closely resembles or correlates with the good prognosis control, and does not resemble or correlate with the poor prognosis control, the individual is classified as having a good prognosis. Where the pool is not pure 'good prognosis' or 'poor prognosis', a set of experiments should be performed in which nucleic acids from samples from individuals with known outcomes are hybridized against the pool to define the expression templates for the good prognosis and poor prognosis groups. Nucleic acids from each individual with unknown outcome are hybridized against the same pool and the resulting expression profile is compared to the templates to predict its outcome.

The control or standard may be presented in a number of different formats. For example, the control, or template, to which the expression of marker genes in a breast cancer tumor sample is compared may be the average absolute level of expression of each of the genes in a pool of marker-derived nucleic acids pooled from breast cancer tumor samples obtained from a plurality of breast cancer patients. In this case, the difference between the absolute level of expression of these genes in the control and in a sample from a breast cancer patient provides the degree of similarity or dissimilarity of the level of expression in the patient sample and the control. The absolute level of expression may be measured by the intensity of the hybridization of the nucleic acids to an array. In other embodiments, the values for the expression levels of the markers in both the patient sample and control are transformed (see Section 5.4.3). For example, the expression level value for the patient, and the average expression level value for the pool, for each of the marker genes selected, may be transformed by taking the logarithm of the value. Moreover, the expression level values may be normalized by, for example, dividing by the median hybridization intensity of all of the samples that make up the pool. The control may be derived from hybridization data obtained simultaneously with the patient sample expression data, or may constitute a set of numerical values stores on a computer, or on computer-readable medium.

In one embodiment, the invention provides for method of determining whether an individual afflicted with breast cancer will likely experience a relapse within five years of initial diagnosis (i.e., whether an individual has a poor prognosis) comprising (1) comparing the level of expression of the markers listed in Table 5 in a sample taken from the individual to the level of the same markers in a standard or control, where the standard or control levels represent those found in an individual with a poor prognosis; and (2) determining whether the level of the marker-related polynucleotides in the sample from the individual is significantly different than that of the control, wherein if no substantial difference is found, the patient has a poor prognosis, and if a substantial difference is found, the patient has a good prognosis. Persons of skill in the art will readily see that the markers associated with good prognosis can also be used as controls. In a more specific embodiment, both controls are run.

Poor prognosis of breast cancer may indicate that a tumor is relatively aggressive, while good prognosis may indicate that a tumor is relatively nonaggressive. Therefore, the invention provides for a method of determining a course of treatment of a breast cancer patient, comprising determining whether the level of expression of the 231 markers of Table 5, or a subset thereof, correlates with the level of these markers in a sample representing a good prognosis expression pattern or a poor prognosis pattern; and determining a course of treatment, wherein if the expression correlates with the poor prognosis pattern, the tumor is treated as an aggressive tumor.

Patients having an expression profile correlating with the good prognosis profile may be further divided into "very good prognosis" and "intermediate prognosis" groups. In the original 78 samples used to determine the 70 optimal prognostic marker genes, patients whose expression profile correlated with (i.e., had a correlation coefficient less than 0.40) the average "good prognosis" expression profile were classified as having a "good prognosis." It was subsequently found that tumors with an expression profile having a coefficient of correlation to the average "good prognosis" expression profile greater than 0.636 developed no distant metastases. These patients may receive a different therapeutic regimen than patients whose tumors have a "good prognosis" expression profile that correlates less strongly to the average "good prognosis" expression profile. Accordingly, patients were classified as having a "very good prognosis" expression profile if the correlation coefficient exceeded 0.636, and an "intermediate prognosis" if their expression profile correlation coefficient was 0.39 or less but less than or equal to 0.636. The data for the 70 genes listed in Table 6 for these 78 patients is listed in Table 7.

This methodology may be generalized to situations in which data from other groups of patients is used, where a group of patients is to provide clinical and expression data to be used for classification of subsequent breast cancer patients. A group of patients is selected for which clinical and followup data are available for at least five years after initial diagnosis. Preferably the patients in the group are selected as a consecutive series to reduce or eliminate selection bias. Breast cancer tumor samples are taken from each patient, and marker-related polynucleotides are generated. The expression levels of each of the marker genes listed in Table 5 or a subset thereof, preferably at least five of the marker genes listed in Table 6, is determined for each tumor sample (i.e., for each patient) to generate a patient expression profile. Marker-derived polynucleotides from patients within the group clinically determined to have a good prognosis (i.e., no distant metastases within five years of initial diagnosis) are pooled and mean expression levels for each of the prognosis-related marker genes are determined to obtain a control expression profile. Patients are then rank ordered in descending order of similarity of patient expression profiles to the control expression profile to produce a rank-ordered list of patients, where the similarity is a value expressed by a single similarity metric such as a correlation coefficient. A first threshold similarity value is then selected, which divides the group of patients into those predicted to have a good prognosis and those predicted to have a poor prognosis. This first threshold similarity value may be the similarity value that most accurately predicts clinical outcomes (i.e., results in an expression profile classification that results in the fewest misclassifications when compared to actual clinical outcomes), or a similarity value that results in a particular number or percentage of false negatives in the group, where a false negative is an expression-based good prognosis prediction for a breast cancer patient that actually develops a distant metastasis within the five year period after initial diagnosis. A second threshold similarity value is then selected which divides the "good prognosis" group into two groups. This threshold similarity value is determined empirically as the similarity value for the patient highest on the rank-ordered list of patients who actually develops a distant metastasis within the five-year period. This second threshold similarity value divides the "good prognosis" group into a group of patients having a "very good prognosis," i.e., those having similarity values equal to or higher than the second threshold similarity value, and an "intermediate prognosis" group, i.e., those having a similarity value equal to or greater than the first threshold similarity value, but less than the second threshold similarity value. Patients whose similarity values are less than the first threshold similarity value are classified as having a "poor prognosis." Subsequent patients may be similarly classified by calculating a similarity value for the patient, where the control is the "good prognosis" template or expression profile, and comparison of this similarity metric to the similarity metrics obtained above.

Thus, in one embodiment, the invention provides a method for classifying a breast cancer patient according to prognosis, comprising comparing the levels of expression of at least five of the genes for which markers are listed in Table 5 in a cell sample taken from said breast cancer patient to control levels of expression of said at least five genes; and classifying said breast cancer patient according to prognosis of his or her breast cancer based on the similarity between said levels of expression in said cell sample and said control levels. In a more specific embodiment, the second step of this method comprises determining whether said similarity exceeds one or more predetermined threshold values of similarity. In another more specific embodiment of this method, said control levels are the mean levels of expression of each of said at least five genes in a pool of tumor samples obtained from a plurality of breast cancer patients who have no distant metastases within five years of initial diagnosis. In another more specific embodiment of this method, said control levels comprise the expression levels of said genes in breast cancer patients who have had no distant metastases within five years of initial diagnosis. In yet another more specific embodiment of this method, said control levels comprise, for each of said at least five of the genes for which markers are listed in Table 5, mean log intensity values stored on a computer. In yet another more specific embodiment of this method, said control levels comprise, for each of said at least five of the genes for which markers are listed in Table 6, mean log intensity values stored on a computer. In another more specific embodiment of this method, said control levels comprise, for each of said at least five genes listed in Table 6, the mean log intensity values that are listed in Table 7. The set of mean log intensity values listed in this table may be used as a "good prognosis" template for any of the prognostic methods described herein. The above method may also compare the level of expression of at least ten, 20, 30, 40, 50, 75, 100 or more genes for which markers listed in Table 5, or may use the 70 preferred genes for which markers are listed in Table 6.

The present invention also provides for the classification of a breast cancer patient into one of three prognostic categories comprising (a) determining the similarity between the level of expression of at least five of the genes for which markers are listed in Table 5 to control levels of expression to obtain a patient similarity value; (b) providing a first threshold similarity value that differentiates persons having a good prognosis from those having a poor prognosis, and providing determining a second threshold similarity value, where said second threshold similarity value indicates a higher degree of similarity of the expression of said genes to said control than said first similarity value; and (c) classifying the breast cancer patient into a first prognostic category if the patient similarity value exceeds the first and second threshold similarity values, a second prognostic category if the patient similarity value equals or exceeds the first but not the second threshold similarity value, and a third prognostic category if the patient similarity value is less than the first threshold similarity value. In a more specific embodiment, the levels of expression of each of said at least five genes is determined first. As above, the control comprises marker-related polynucleotides derived from breast cancer tumor samples taken from breast cancer patients clinically determined to have a good prognosis ("good prognosis" control), breast cancer patients clinically determined to have a poor prognosis "poor prognosis" control), or both. In a preferred embodiment, the control is a "good prognosis" control or template, i.e., a control or template comprising the mean levels of expression of said genes in breast cancer patients who have had no distant metastases within five years of initial diagnosis. In another more specific embodiment, said control levels comprise a set of values, for example mean log intensity values, preferably normalized, stored on a computer. In a more specific embodiment, said control or template is the set of mean log intensity values shown in Table 7. In another specific embodiment, said determining in step (a) may be accomplished by a method comprising determining the difference between the absolute expression level of each of said genes and the average expression level of the same genes in a pool of tumor samples obtained from a plurality of breast cancer patients who have had no relapse of breast cancer within five years of initial diagnosis. In another specific embodiment, said determining in step (a) may be accomplished by a method comprising determining the degree of similarity between the level of expression of each of said genes in a breast cancer tumor sample taken from a breast cancer patient and the level of expression of the same genes in a pool of tumor samples obtained from a plurality of breast cancer patients who have had no relapse of breast cancer within five years of initial diagnosis.

In a specific embodiment of the above method, said first threshold similarity value and said second threshold similarity values are selected by a method comprising (a) rank ordering in descending order said tumor samples that compose said pool of tumor samples by the degree of similarity between the level of expression of said genes in each of said tumor samples to the mean level of expression of the same genes of the remaining tumor samples that compose said pool to obtain a rank-ordered list, said degree of similarity being expressed as a similarity value; (b) determining an acceptable number of false negatives in said classifying, wherein said false negatives are breast cancer patients for whom the expression levels of said at least five of the genes for which markers are listed in Table 5 in said cell sample predicts that said patient will have no distant metastases within the first five years after initial diagnosis, but who has had a distant metastasis within the first five years after initial diagnosis; (c) determining a similarity value above which in said rank ordered list fewer than said acceptable number of tumor samples are false negatives; and (d) selecting said similarity value determined in step (c) as said first threshold similarity value; and (e) selecting a second similarity value, greater than said first similarity value, as said second threshold similarity value. In an even more specific embodiment of this method, said second threshold similarity value is selected in step (e) by a method comprising determining which of said tumor samples, taken from patients having a distant metastasis within five years of initial diagnosis, in said rank ordered list has the greatest similarity value, and selecting said greatest similarity value as said second threshold similarity value. In even more specific embodiments, said first and second threshold similarity values are correlation coefficients, and said first threshold similarity value is 0.4 and said second threshold similarity value is greater than 0.4. In another even more specific embodiment, using the template data provided in Table 7, said first and second threshold similarity values are correlation coefficients, and said second threshold similarity value is 0.636. In another specific embodiment, said first similarity value is a similarity value above which at most 10% false negatives are predicted in a training set of tumors, and said second correlation coefficient is a coefficient above which at most 5% false negatives are predicted in said training set of tumors. In another specific embodiment, said first correlation coefficient is a coefficient above which 10% false negatives are predicted in a training set of tumors, and said second correlation coefficient is a coefficient above which no false negatives are predicted in said training set of tumors. In the above and other embodiments, "false negatives" are patients classified by the expression of the marker genes as having a good prognosis, or who are predicted by such expression to have a good prognosis, but who actually do develop distant metastases within five years.

In a specific embodiment of the above methods, the first, second and third prognostic categories are "very good prognosis," "intermediate prognosis," and "poor prognosis," respectively. Patients classified into the first prognostic category ("very good prognosis") are likely not to have a distant metastasis within five years of initial diagnosis. Patients classified as having an "intermediate prognosis" are also unlikely to have a distant metastasis within five years of initial diagnosis, but may be recommended to undergo a different therapeutic regimen than patients having a "very good prognosis" marker gene expression profile (see below). Patients classified into the third prognostic category ("poor prognosis") are likely to have a distant metastasis within five years of initial diagnosis.

In a more specific embodiment, the similarity value is the degree of difference between the absolute (i.e., untransformed) level of expression of each of the genes in a tumor sample taken from a breast cancer patient and the mean absolute level of expression of the same genes in a control. In another more specific embodiment, the similarity value is calculated using expression level data that is transformed (see Section 5.4.3). In another more specific embodiment, the similarity value is expressed as a similarity metric, such as a correlation coefficient, representing the similarity between the level of expression of the marker genes in the tumor sample and the mean level of expression of the same genes in a plurality of breast cancer tumor samples taken from breast cancer patients.

In another specific embodiment, said first and second similarity values are derived from control expression data obtained in the same hybridization experiment as that in which the patient expression level data is obtained. In another specific embodiment, said first and second similarity values are derived from an existing set of expression data. In a more specific embodiment, said first and second correlation coefficients are derived from a mathematical sample pool (see Section 5.4.3; Example 9). For example, comparison of the expression of marker genes in new tumor samples may be compared to the pre-existing template determined for these genes for the 78 patients in the initial study; the template, or average expression levels of each of the seventy genes can be used as a reference or control for any tumor sample. Preferably, the comparison is made to a template comprising the average expression level of at least five of the 70 genes listed in Table 6 for the 44 out of 78 patients clinically determined to have a good prognosis. The coefficient of correlation of the level of expression of these genes in the tumor sample to the 44 "good prognosis" patient template is then determined to produce a tumor correlation coefficient. For this control patient set, two similarity values have been derived: a first correlation coefficient of 0.4 and a second correlation coefficient of 0.636, derived using the 70 marker gene set listed in Table 6. New breast cancer patients whose coefficients of correlation of the expression of these marker genes with the 44-patient "good prognosis" template equal or exceed 0.636 are classified as having a "very good prognosis"; those having a coefficient of correlation of between 0.4 and 0.635 are classified as having an "intermediate prognosis"; and those having a correlation coefficient of 0.39 or less are classified as having a "poor prognosis."

Because the above methods may utilize arrays to which fluorescently-labeled marker-derived target nucleic acids are hybridized, the invention also provides a method of classifying a breast cancer patient according to prognosis comprising the steps of (a) contacting first nucleic acids derived from a tumor sample taken from said breast cancer patient, and second nucleic acids derived from two or more tumor samples from breast cancer patients who have had no distant metastases within five years of initial diagnosis, with an array under conditions such that hybridization can occur, detecting at each of a plurality of discrete loci on said array a first fluorescent emission signal from said first nucleic acids and a second fluorescent emission signal from said second nucleic acids that are bound to said array under said conditions, wherein said array comprises at least five of the genes for which markers are listed in Table 5 and wherein at least 50% of the probes on said array are listed in Table 5; (b) calculating the similarity between said first fluorescent emission signals and said second fluorescent emission signals across said at least five genes; and (c) classifying said breast cancer patient according to prognosis of his or her breast cancer based on the similarity between said first fluorescent emission signals and said second fluorescent emission signals across said at least five genes.

Once patients have been classified as having a "very good prognosis," "intermediate prognosis" or "poor prognosis," this information can be combined with the patient's clinical data to determine an appropriate treatment regimen. In one embodiment, the patient's lymph node metastasis status (i.e., whether the patient is pN+ or pN0) is determined. Patients who are pN0 and have a "very good prognosis" or "intermediate" expression profile may be treated without adjuvant chemotherapy. All other patients should be treated with adjuvant chemotherapy. In a more specific embodiment, the patient's estrogen receptor status is also identified (i.e., whether the patient is ER(+) or ER(−)). Here, patients classified as having an "intermediate prognosis" or "poor prognosis" who are ER(+) are assigned a therapeutic regimen that additionally comprises adjuvant hormonal therapy.

Thus, the invention provides for a method of assigning a therapeutic regimen to a breast cancer patient, comprising (a) classifying said patient as having a "poor prognosis," "intermediate prognosis," or "very good prognosis" on the basis of the levels of expression of at least five of the genes for which markers are listed in Table 5; and (b) assigning said patient a therapeutic regimen, said therapeutic regimen comprising no adjuvant chemotherapy if the patient is lymph node negative and is classified as having a good prognosis or an intermediate prognosis, or comprising chemotherapy if said patient has any other combination of lymph node status and expression profile. In another embodiment, the invention provides a method for assigning a therapeutic regimen for a breast cancer patient, comprising determining the lymph node status for said patient; determining the level of expression of at least five of the genes listed in Table 5 in a tumor sample from said patient, thereby generating an expression profile; classifying said patient as having a "poor prognosis", "intermediate prognosis" or "very good prognosis" on the basis of said expression profile; and assigning the patient a therapeutic regimen, said therapeutic regimen comprising no adjuvant chemotherapy if the patient is lymph node negative and is classified as having a good prognosis or an intermediate prognosis, or a therapeutic regiment comprising chemotherapy if said patient has any other combination of lymph node status and expression profile. In a more specific embodiment of the above methods, the ER status of the patient is additionally determined, and if the breast cancer patient is ER(+) and has an intermediate or poor prognosis, the therapeutic regimen additionally comprises hormonal therapy. Because in the training set of 78 breast cancer patients it was determined that the great majority of intermediate prognosis patients were also ER(+) (see Example 10), another more specific embodiment is to determine the lymph node status and expression profiles, and to assign intermediate prognosis patients adjuvant hormonal therapy (whether or not ER status has been determined). In another specific embodiment, the breast cancer patient is 52 years of age or younger. In another specific embodiment, the breast cancer patient is premenopausal. In another specific embodiment, the breast cancer patient has stage I or stage II breast cancer.

The use of marker sets is not restricted to the prognosis of breast cancer-related conditions, and may be applied in a variety of phenotypes or conditions, clinical or experimental, in which gene expression plays a role. Where a set of markers has been identified that corresponds to two or more phenotypes, the marker set can be used to distinguish these phenotypes. For example, the phenotypes may be the diagnosis and/or prognosis of clinical states or phenotypes associated with other cancers, other disease conditions, or other physiological conditions, wherein the expression level data is derived from a set of genes correlated with the particular physiological or disease condition. Further, the expression of markers specific to other types of cancer may be used to differentiate patients or patient populations for those cancers for which different therapeutic regimens are indicated.

5.4.3 Improving Sensitivity to Expression Level Differences

In using the markers disclosed herein, and, indeed, using any sets of markers to differentiate an individual having one phenotype from another individual having a second phenotype, one can compare the absolute expression of each of the markers in a sample to a control; for example, the control can be the average level of expression of each of the markers, respectively, in a pool of individuals. To increase the sensitivity of the comparison, however, the expression level values are preferably transformed in a number of ways.

For example, the expression level of each of the markers can be normalized by the average expression level of all markers the expression level of which is determined, or by the average expression level of a set of control genes. Thus, in one embodiment, the markers are represented by probes on a microarray, and the expression level of each of the markers is normalized by the mean or median expression level across all of the genes represented on the microarray, including any non-marker genes. In a specific embodiment, the normalization is carried out by dividing the median or mean level of expression of all of the genes on the microarray. In another embodiment, the expression levels of the markers is normalized by the mean or median level of expression of a set of control markers. In a specific embodiment, the control markers comprise a set of housekeeping genes. In another specific embodiment, the normalization is accomplished by dividing by the median or mean expression level of the control genes.

The sensitivity of a marker-based assay will also be increased if the expression levels of individual markers are compared to the expression of the same markers in a pool of samples. Preferably, the comparison is to the mean or median expression level of each the marker genes in the pool of samples. Such a comparison may be accomplished, for example, by dividing by the mean or median expression level of the pool for each of the markers from the expression level each of the markers in the sample. This has the effect of accentuating the relative differences in expression between markers in the sample and markers in the pool as a whole, making comparisons more sensitive and more likely to produce meaningful results that the use of absolute expression levels alone. The expression level data may be transformed in any convenient way; preferably, the expression level data for all is log transformed before means or medians are taken.

In performing comparisons to a pool, two approaches may be used. First, the expression levels of the markers in the sample may be compared to the expression level of those markers in the pool, where nucleic acid derived from the sample and nucleic acid derived from the pool are hybridized during the course of a single experiment. Such an approach requires that new pool nucleic acid be generated for each comparison or limited numbers of comparisons, and is therefore limited by the amount of nucleic acid available. Alternatively, and preferably, the expression levels in a pool, whether normalized and/or transformed or not, are stored on a computer, or on computer-readable media, to be used in comparisons to the individual expression level data from the sample (i.e., single-channel data).

Thus, the current invention provides the following method of classifying a first cell or organism as having one of at least two different phenotypes, where the different phenotypes comprise a first phenotype and a second phenotype. The level of expression of each of a plurality of genes in a first sample from the first cell or organism is compared to the level of expression of each of said genes, respectively, in a pooled sample from a plurality of cells or organisms, the plurality of cells or organisms comprising different cells or organisms exhibiting said at least two different phenotypes, respectively, to produce a first compared value. The first compared value is then compared to a second compared value, wherein said second compared value is the product of a method comprising comparing the level of expression of each of said genes in a sample from a cell or organism characterized as having said first phenotype to the level of expression of each of said genes, respectively, in the pooled sample. The first compared value is then compared to a third compared value, wherein said third compared value is the product of a method comprising comparing the level of expression of each of the genes in a sample from a cell or organism characterized as having the second phenotype to the level of expression of each of the genes, respectively, in the pooled sample. Optionally, the first compared value can be compared to additional compared values, respectively, where each additional compared value is the product of a method comprising comparing the level of expression of each of said genes in a sample from a cell or organism characterized as having a phenotype different from said first and second phenotypes but included among the at least two different phenotypes, to the level of expression of each of said genes, respectively, in said pooled sample. Finally, a determination is made as to which of said second, third, and, if present, one or more additional compared values, said first compared value is most similar, wherein the first cell or organism is determined to have the phenotype of the cell or organism used to produce said compared value most similar to said first compared value.

In a specific embodiment of this method, the compared values are each ratios of the levels of expression of each of said genes. In another specific embodiment, each of the levels of expression of each of the genes in the pooled sample are normalized prior to any of the comparing steps. In a more specific embodiment, the normalization of the levels of expression is carried out by dividing by the median or mean level of the expression of each of the genes or dividing by the mean or median level of expression of one or more housekeeping genes in the pooled sample from said cell or organism. In another specific embodiment, the normalized levels of expression are subjected to a log transform, and the comparing steps comprise subtracting the log transform from the log of the levels of expression of each of the genes in the sample. In another specific embodiment, the two or more different phenotypes are different stages of a disease or disorder. In still another specific embodiment, the two or more different phenotypes are different prognoses of a disease or disorder. In yet another specific embodiment, the levels of expression of each of the genes, respectively, in the pooled sample or said levels of expression of each of said genes in a sample from the cell or organism characterized as having the first phenotype, second phenotype, or said phenotype different from said first and second phenotypes, respectively, are stored on a computer or on a computer-readable medium.

In another specific embodiment, the two phenotypes are ER(+) or ER(−) status. In another specific embodiment, the two phenotypes are BRCA1 or sporadic tumor-type status. In yet another specific embodiment, the two phenotypes are good prognosis and poor prognosis.

In another specific embodiment, the comparison is made between the expression of each of the genes in the sample and the expression of the same genes in a pool representing only one of two or more phenotypes. In the context of prognosis-correlated genes, for example, one can compare the expression levels of prognosis-related genes in a sample to the average level of the expression of the same genes in a "good prognosis" pool of samples (as opposed to a pool of samples that include samples from patients having poor prognoses and good prognoses). Thus, in this method, a sample is classified as having a good prognosis if the level of expression of prognosis-correlated genes exceeds a chosen coefficient of correlation to the average "good prognosis" expression profile (i.e., the level of expression of prognosis-correlated genes in a pool of samples from patients having a "good prognosis." Patients whose expression levels correlate more poorly with the "good prognosis" expression profile (i.e., whose correlation coefficient fails to exceed the chosen coefficient) are classified as having a poor prognosis. The method can be applied to subdivisions of these prognostic classes. For example, in a specific embodiment, the phenotype is good prognosis and said determination comprises (1) determining the coefficient of correlation between the expression of said plurality of genes in the sample and of the same genes in said pooled sample; (2) selecting a first correlation coefficient value between 0.4 and +1 and a second correlation coefficient value between 0.4 and +1, wherein said second value is larger than said first value; and (3) classifying said sample as "very good prognosis" if said coefficient of correlation equals or is greater than said second correlation coefficient value, "intermediate prognosis" if said coefficient of correlation equals or exceeds said first correlation coefficient value, and is less than said second correlation coefficient value, or "poor prognosis" if said coefficient of correlation is less than said first correlation coefficient value.

Of course, single-channel data may also be used without specific comparison to a mathematical sample pool. For example, a sample may be classified as having a first or a second phenotype, wherein the first and second phenotypes are related, by calculating the similarity between the expression of at least 5 markers in the sample, where the markers are correlated with the first or second phenotype, to the expression of the same markers in a first phenotype template and a second phenotype template, by (a) labeling nucleic acids derived from a sample with a fluorophore to obtain a pool of fluorophore-labeled nucleic acids; (b) contacting said fluorophore-labeled nucleic acid with a microarray under conditions such that hybridization can occur, detecting at each of a plurality of discrete loci on the microarray a flourescent emission signal from said fluorophore-labeled nucleic acid that is bound to said microarray under said conditions; and (c) determining the similarity of marker gene expression in the individual sample to the first and second templates, wherein if said expression is more similar to the first template, the sample is classified as having the first phenotype, and if said expression is more similar to the second template, the sample is classified as having the second phenotype.

5.5 Determination of Marker Gene Expression Levels 5.5.1 Methods

The expression levels of the marker genes in a sample may be determined by any means known in the art. The expression level may be determined by isolating and determining the level (i.e., amount) of nucleic acid transcribed from each marker gene. Alternatively, or additionally, the level of specific proteins translated from mRNA transcribed from a marker gene may be determined.

The level of expression of specific marker genes can be accomplished by determining the amount of mRNA, or polynucleotides derived therefrom, present in a sample. Any method for determining RNA levels can be used. For example, RNA is isolated from a sample and separated on an agarose gel. The separated RNA is then transferred to a solid support, such as a filter. Nucleic acid probes representing one or more markers are then hybridized to the filter by northern hybridization, and the amount of marker-derived RNA is determined. Such determination can be visual, or machine-aided, for example, by use of a densitometer. Another method of determining RNA levels is by use of a dot-blot or a slot-blot. In this method, RNA, or nucleic acid derived therefrom, from a sample is labeled. The RNA or nucleic acid derived therefrom is then hybridized to a filter containing oligonucleotides derived from one or more marker genes, wherein the oligonucleotides are placed upon the filter at discrete, easily-identifiable locations. Hybridization, or lack thereof, of the labeled RNA to the filter-bound oligonucleotides is determined visually or by densitometer. Polynucleotides can be labeled using a radiolabel or a fluorescent (i.e., visible) label.

These examples are not intended to be limiting; other methods of determining RNA abundance are known in the art.

The level of expression of particular marker genes may also be assessed by determining the level of the specific protein expressed from the marker genes. This can be accomplished, for example, by separation of proteins from a sample on a polyacrylamide gel, followed by identification of specific marker-derived proteins using antibodies in a western blot. Alternatively, proteins can be separated by two-dimensional gel electrophoresis systems. Two-dimensional gel electrophoresis is well-known in the art and typically involves isoelectric focusing along a first dimension followed by SDS-PAGE electrophoresis along a second dimension. See, e.g., Hames et al, 1990, GEL ELECTROPHORESIS OF PROTEINS: A PRACTICAL APPROACH, IRL Press, New York; Shevchenko et al., *Proc. Nat'l Acad. Sci. USA* 93:1440–1445 (1996); Sagliocco et al., *Yeast* 12:1519–1533 (1996); Lander, *Science* 274:536–539 (1996). The resulting electropherograms can be analyzed by numerous techniques, including mass spectrometric techniques, western blotting and immunoblot analysis using polyclonal and monoclonal antibodies.

Alternatively, marker-derived protein levels can be determined by constructing an antibody microarray in which binding sites comprise immobilized, preferably monoclonal, antibodies specific to a plurality of protein species encoded by the cell genome. Preferably, antibodies are present for a substantial fraction of the marker-derived proteins of interest. Methods for making monoclonal antibodies are well known (see, e.g., Harlow and Lane, 1988, ANTIBODIES: A LABORATORY MANUAL, Cold Spring Harbor, N.Y., which is incorporated in its entirety for all purposes). In one embodiment, monoclonal antibodies are raised against synthetic peptide fragments designed based on genomic sequence of the cell. With such an antibody array, proteins from the cell are contacted to the array, and their binding is assayed with assays known in the art. Generally, the expression, and the level of expression, of proteins of diagnostic or prognostic interest can be detected through immunohistochemical staining of tissue slices or sections.

Finally, expression of marker genes in a number of tissue specimens may be characterized using a "tissue array" (Kononen et al., Nat. Med 4(7):844–7 (1998)). In a tissue array, multiple tissue samples are assessed on the same microarray. The arrays allow in situ detection of RNA and protein levels; consecutive sections allow the analysis of multiple samples simultaneously.

5.5.2 Microarrays

In preferred embodiments, polynucleotide microarrays are used to measure expression so that the expression status of each of the markers above is assessed simultaneously. In a specific embodiment, the invention provides for oligonucleotide or cDNA arrays comprising probes hybridizable to the genes corresponding to each of the marker sets described above (i.e., markers to determine the molecular type or subtype of a tumor; markers to distinguish ER status; markers to distinguish BRCA1 from sporadic tumors; markers to distinguish patients with good versus patients with poor prognosis; markers to distinguish both ER(+) from ER(−), and BRCA1 tumors from sporadic tumors; markers to distinguish ER(+) from ER(−), and patients with good prognosis from patients with poor prognosis; markers to distinguish BRCA1 tumors from sporadic tumors, and patients with good prognosis from patients with poor prognosis; and markers able to distinguish ER(+) from ER(−), BRCA1 tumors from sporadic tumors, and patients with good prognosis from patients with poor prognosis; and markers unique to each status).

The microarrays provided by the present invention may comprise probes hybridizable to the genes corresponding to markers able to distinguish the status of one, two, or all three of the clinical conditions noted above. In particular, the invention provides polynucleotide arrays comprising probes to a subset or subsets of at least 50, 100, 200, 300, 400, 500, 750, 1,000, 1,250, 1,500, 1,750, 2,000 or 2,250 genetic markers, up to the full set of 2,460 markers, which distinguish ER(+) and ER(−) patients or tumors. The invention also provides probes to subsets of at least 20, 30, 40, 50, 75, 100, 150, 200, 250, 300, 350 or 400 markers, up to the full set of 430 markers, which distinguish between tumors containing a BRCA1 mutation and sporadic tumors within an ER(−) group of tumors. The invention also provides probes to subsets of at least 20, 30, 40, 50, 75, 100, 150 or 200 markers, up to the full set of 231 markers, which distinguish between patients with good and poor prognosis within sporadic tumors. In a specific embodiment, the array comprises probes to marker sets or subsets directed to any two of the clinical conditions. In a more specific embodiment, the array comprises probes to marker sets or subsets directed to all three clinical conditions.

In specific embodiments, the invention provides polynucleotide arrays in which the breast cancer-related markers described herein comprise at least 50%, 60%, 70%, 80%, 85%, 90%, 95% or 98% of the probes on said array. In another specific embodiment, the invention provides polynucleotide arrays in which ER status-related markers selected from Table 1 comprise at least 50%, 60%, 70%, 80%, 85%, 90%, 95% or 98% of the probes on said array. In another specific embodiment, the invention provides polynucleotide arrays in which BRCA1/sporadic markers selected from Table 3 comprise at least 50%, 60%, 70%, 80%, 85%, 90%, 95% or 98% of the probes on said array. In another specific embodiment, the invention provides polynucleotide arrays in which prognostic markers selected from Table 5 comprise at least 50%, 60%, 70%, 80%, 85%, 90%, 95% or 98% of the probes on said array.

In yet another specific embodiment, microarrays that are used in the methods disclosed herein optionally comprise markers additional to at least some of the markers listed in Tables 1–6. For example, in a specific embodiment, the microarray is a screening or scanning array as described in Altschuler et al., International Publication WO 02/18646, published Mar. 7, 2002 and Scherer et al., International Publication WO 02/16650, published Feb. 28, 2002. The scanning and screening arrays comprise regularly-spaced, positionally-addressable probes derived from genomic nucleic acid sequence, both expressed and unexpressed. Such arrays may comprise probes corresponding to a subset of, or all of, the markers listed in Tables 1–6, or a subset thereof as described above, and can be used to monitor marker expression in the same way as a microarray containing only markers listed in Tables 1–6.

In yet another specific embodiment, the microarray is a commercially-available cDNA microarray that comprises at least five of the markers listed in Tables 1–6. Preferably, a commercially-available cDNA microarray comprises all of the markers listed in Tables 1–6. However, such a microarray may comprise 5, 10, 15, 25, 50, 100, 150, 250, 500, 1000 or more of the markers in any of Tables 1–6, up to the maximum number of markers in a Table, and may comprise all of the markers in any one of Tables 1–6 and a subset of another of Tables 1–6, or subsets of each as described above. In a specific embodiment of the microarrays used in the methods disclosed herein, the markers that are all or a portion of Tables 1–6 make up at least 50%, 60%, 70%, 80%, 90%, 95% or 98% of the probes on the microarray.

General methods pertaining to the construction of microarrays comprising the marker sets and/or subsets above are described in the following sections.

5.5.2.1 Construction of Microarrays

Microarrays are prepared by selecting probes which comprise a polynucleotide sequence, and then immobilizing such probes to a solid support or surface. For example, the probes may comprise DNA sequences, RNA sequences, or copolymer sequences of DNA and RNA. The polynucleotide sequences of the probes may also comprise DNA and/or RNA analogues, or combinations thereof. For example, the polynucleotide sequences of the probes may be full or partial fragments of genomic DNA. The polynucleotide sequences of the probes may also be synthesized nucleotide sequences, such as synthetic oligonucleotide sequences. The probe sequences can be synthesized either enzymatically in vivo, enzymatically in vitro (e.g., by PCR), or non-enzymatically in vitro.

The probe or probes used in the methods of the invention are preferably immobilized to a solid support which may be either porous or non-porous. For example, the probes of the invention may be polynucleotide sequences which are attached to a nitrocellulose or nylon membrane or filter covalently at either the 3' or the 5' end of the polynucleotide. Such hybridization probes are well known in the art (see, e.g., Sambrook et al., MOLECULAR CLONING—A LABORATORY MANUAL (2ND ED.), Vols. 1–3, Cold Spring Harbor Laboratory, Cold Spring Harbor, N.Y. (1989). Alternatively, the solid support or surface may be a glass or plastic surface. In a particularly preferred embodiment, hybridization levels are measured to microarrays of probes consisting of a solid phase on the surface of which are immobilized a population of polynucleotides, such as a population of DNA or DNA mimics, or, alternatively, a population of RNA or RNA mimics. The solid phase may be a nonporous or, optionally, a porous material such as a gel.

In preferred embodiments, a microarray comprises a support or surface with an ordered array of binding (e.g., hybridization) sites or "probes" each representing one of the markers described herein. Preferably the microarrays are addressable arrays, and more preferably positionally addressable arrays. More specifically, each probe of the array is preferably located at a known, predetermined position on the solid support such that the identity (i.e., the sequence) of each probe can be determined from its position in the array (i.e., on the support or surface). In preferred embodiments, each probe is covalently attached to the solid support at a single site.

Microarrays can be made in a number of ways, of which several are described below. However produced, microarrays share certain characteristics. The arrays are reproducible, allowing multiple copies of a given array to be produced and easily compared with each other. Preferably, microarrays are made from materials that are stable under binding (e.g., nucleic acid hybridization) conditions. The microarrays are preferably small, e.g., between 1 cm$^2$ and 25 cm$^2$, between 12 cm$^2$ and 13 cm$^2$, or 3 cm$^2$. However, larger arrays are also contemplated and may be preferable, e.g., for use in screening arrays. Preferably, a given binding site or unique set of binding sites in the microarray will specifically bind (e.g., hybridize) to the product of a single gene in a cell (e.g., to a specific mRNA, or to a specific cDNA derived therefrom). However, in general, other related or similar sequences will cross hybridize to a given binding site.

The microarrays of the present invention include one or more test probes, each of which has a polynucleotide sequence that is complementary to a subsequence of RNA or DNA to be detected. Preferably, the position of each probe on the solid surface is known. Indeed, the microarrays are preferably positionally addressable arrays. Specifically, each probe of the array is preferably located at a known, predetermined position on the solid support such that the identity (i.e., the sequence) of each probe can be determined from its position on the array (i.e., on the support or surface).

According to the invention, the microarray is an array (i.e., a matrix) in which each position represents one of the markers described herein. For example, each position can contain a DNA or DNA analogue based on genomic DNA to which a particular RNA or cDNA transcribed from that genetic marker can specifically hybridize. The DNA or DNA analogue can be, e.g., a synthetic oligomer or a gene fragment. In one embodiment, probes representing each of the markers is present on the array. In a preferred embodiment, the array comprises the 550 of the 2,460 RE-status markers, 70 of the BRCA1/sporadic markers, and all 231 of the prognosis markers.

5.5.2.2 Preparing Probes for Microarrays

As noted above, the "probe" to which a particular polynucleotide molecule specifically hybridizes according to the invention contains a complementary genomic polynucleotide sequence. The probes of the microarray preferably consist of nucleotide sequences of no more than 1,000 nucleotides. In some embodiments, the probes of the array consist of nucleotide sequences of 10 to 1,000 nucleotides. In a preferred embodiment, the nucleotide sequences of the probes are in the range of 10–200 nucleotides in length and are genomic sequences of a species of organism, such that a plurality of different probes is present, with sequences complementary and thus capable of hybridizing to the genome of such a species of organism, sequentially tiled across all or a portion of such genome. In other specific embodiments, the probes are in the range of 10–30 nucleotides in length, in the range of 10–40 nucleotides in length, in the range of 20–50 nucleotides in length, in the range of 40–80 nucleotides in length, in the range of 50–150 nucleotides in length, in the range of 80–120 nucleotides in length, and most preferably are 60 nucleotides in length.

The probes may comprise DNA or DNA "mimics" (e.g., derivatives and analogues) corresponding to a portion of an organism's genome. In another embodiment, the probes of the microarray are complementary RNA or RNA mimics. DNA mimics are polymers composed of subunits capable of specific, Watson-Crick-like hybridization with DNA, or of specific hybridization with RNA. The nucleic acids can be modified at the base moiety, at the sugar moiety, or at the phosphate backbone. Exemplary DNA mimics include, e.g., phosphorothioates.

DNA can be obtained, e.g., by polymerase chain reaction (PCR) amplification of genomic DNA or cloned sequences. PCR primers are preferably chosen based on a known sequence of the genome that will result in amplification of specific fragments of genomic DNA. Computer programs that are well known in the art are useful in the design of primers with the required specificity and optimal amplification properties, such as Oligo version 5.0 (National Biosciences). Typically each probe on the microarray will be between 10 bases and 50,000 bases, usually between 300 bases and 1,000 bases in length. PCR methods are well known in the art, and are described, for example, in Innis et al., eds., PCR PROTOCOLS: A GUIDE TO METHODS AND APPLICATIONS, Academic Press Inc., San Diego, Calif. (1990). It will be apparent to one skilled in the art that controlled robotic systems are useful for isolating and amplifying nucleic acids.

An alternative, preferred means for generating the polynucleotide probes of the microarray is by synthesis of synthetic polynucleotides or oligonucleotides, e.g., using N-phosphonate or phosphoramidite chemistries (Froehler et al., *Nucleic Acid Res.* 14:5399–5407 (1986); McBride et al., *Tetrahedron Lett.* 24:246–248 (1983)). Synthetic sequences are typically between about 10 and about 500 bases in length, more typically between about 20 and about 100 bases, and most preferably between about 40 and about 70 bases in length. In some embodiments, synthetic nucleic acids include non-natural bases, such as, but by no means limited to, inosine. As noted above, nucleic acid analogues may be used as binding sites for hybridization. An example of a suitable nucleic acid analogue is peptide nucleic acid (see, e.g., Egholm et al., *Nature* 363:566–568 (1993); U.S. Pat. No. 5,539,083). Probes are preferably selected using an algorithm that takes into account binding energies, base composition, sequence complexity, cross-hybridization binding energies, and secondary structure (see Friend et al., International Patent Publication WO 01/05935, published Jan. 25, 2001; Hughes et al., *Nat. Biotech.* 19:342–7 (2001)).

A skilled artisan will also appreciate that positive control probes, e.g., probes known to be complementary and hybridizable to sequences in the target polynucleotide molecules, and negative control probes, e.g., probes known to not be complementary and hybridizable to sequences in the target polynucleotide molecules, should be included on the array. In one embodiment, positive controls are synthesized along the perimeter of the array. In another embodiment, positive controls are synthesized in diagonal stripes across the array. In still another embodiment, the reverse complement for each probe is synthesized next to the position of the probe to serve as a negative control. In yet another embodiment, sequences from other species of organism are used as negative controls or as "spike-in" controls.

5.5.2.3 Attaching Probes to the Solid Surface

The probes are attached to a solid support or surface, which may be made, e.g., from glass, plastic (e.g., polypropylene, nylon), polyacrylamide, nitrocellulose, gel, or other porous or nonporous material. A preferred method for attaching the nucleic acids to a surface is by printing on glass plates, as is described generally by Schena et al, *Science* 270:467–470 (1995). This method is especially useful for preparing microarrays of cDNA (See also, DeRisi et al, *Nature Genetics* 14:457–460 (1996); Shalon et al., *Genome Res.* 6:639–645 (1996); and Schena et al., *Proc. Natl. Acad. Sci. U.S.A.* 93:10539–11286 (1995)).

A second preferred method for making microarrays is by making high-density oligonucleotide arrays. Techniques are known for producing arrays containing thousands of oligonucleotides complementary to defined sequences, at defined locations on a surface using photolithographic techniques for synthesis in situ (see, Fodor et al., 1991, *Science* 251: 767–773; Pease et al., 1994, *Proc. Natl. Acad. Sci. U.S.A.* 91:5022–5026; Lockhart et al., 1996, *Nature Biotechnology* 14:1675; U.S. Pat. Nos. 5,578,832; 5,556,752; and 5,510,270) or other methods for rapid synthesis and deposition of defined oligonucleotides (Blanchard et al., *Biosensors & Bioelectronics* 11:687–690). When these methods are used, oligonucleotides (e.g., 60-mers) of known sequence are synthesized directly on a surface such as a derivatized glass slide. Usually, the array produced is redundant, with several oligonucleotide molecules per RNA.

Other methods for making microarrays, e.g., by masking (Maskos and Southern, 1992, *Nuc. Acids. Res.* 20:1679–1684), may also be used. In principle, and as noted supra, any type of array, for example, dot blots on a nylon hybridization membrane (see Sambrook et al., MOLECULAR CLONING—A LABORATORY MANUAL (2ND ED.), Vols. 1–3, Cold Spring Harbor Laboratory, Cold Spring Harbor, N.Y. (1989)) could be used. However, as will be recognized by those skilled in the art, very small arrays will frequently be preferred because hybridization volumes will be smaller.

In one embodiment, the arrays of the present invention are prepared by synthesizing polynucleotide probes on a support. In such an embodiment, polynucleotide probes are attached to the support covalently at either the 3' or the 5' end of the polynucleotide.

In a particularly preferred embodiment, microarrays of the invention are manufactured by means of an ink jet printing device for oligonucleotide synthesis, e.g., using the methods and systems described by Blanchard in U.S. Pat. No. 6,028,189; Blanchard et al., 1996, *Biosensors and Bioelectronics* 11:687–690; Blanchard, 1998, in SYNTHETIC DNA ARRAYS IN GENETIC ENGINEERING, Vol. 20, J. K. Setlow, Ed., Plenum Press, New York at pages 111–123. Specifically, the oligonucleotide probes in such microarrays are preferably synthesized in arrays, e.g., on a glass slide, by serially depositing individual nucleotide bases in "microdroplets" of a high surface tension solvent such as propylene carbonate. The microdroplets have small volumes (e.g., 100 pL or less, more preferably 50 pL or less) and are separated from each other on the microarray (e.g., by hydrophobic domains) to form circular surface tension wells which define the locations of the array elements (i.e., the different probes). Microarrays manufactured by this ink-jet method are typically of high density, preferably having a density of at least about 2,500 different probes per 1 $cm^2$. The polynucleotide probes are attached to the support covalently at either the 3' or the 5' end of the polynucleotide.

5.5.2.4 Target Polynucleotide Molecules

The polynucleotide molecules which may be analyzed by the present invention (the "target polynucleotide molecules") may be from any clinically relevant source, but are expressed RNA or a nucleic acid derived therefrom (e.g., cDNA or amplified RNA derived from cDNA that incorporates an RNA polymerase promoter), including naturally occurring nucleic acid molecules, as well as synthetic nucleic acid molecules. In one embodiment, the target polynucleotide molecules comprise RNA, including, but by no means limited to, total cellular RNA, poly(A)$^+$ messenger RNA (mRNA) or fraction thereof, cytoplasmic mRNA, or RNA transcribed from cDNA (i.e., cRNA; see, e.g., Linsley & Schelter, U.S. patent application Ser. No. 09/411,074, filed Oct. 4, 1999, or U.S. Pat. Nos. 5,545,522, 5,891,636, or 5,716,785). Methods for preparing total and poly(A)$^+$ RNA are well known in the art, and are described generally, e.g., in Sambrook et al., MOLECULAR CLONING—A LABORATORY MANUAL (2ND ED.), Vols. 1–3, Cold Spring Harbor Laboratory, Cold Spring Harbor, N.Y. (1989). In one embodiment, RNA is extracted from cells of the various types of interest in this invention using guanidinium thiocyanate lysis followed by CsCl centrifugation (Chirgwin et al., 1979, *Biochemistry* 18:5294–5299). In another embodiment, total RNA is extracted using a silica gel-based column, commercially available examples of which include RNeasy (Qiagen, Valencia, Calif.) and StrataPrep (Stratagene, La Jolla, Calif.). In an alternative embodiment, which is preferred for *S. cerevisiae*, RNA is extracted from cells using phenol and chloroform, as described in Ausubel et al., eds., 1989, CURRENT PROTOCOLS IN MOLECULAR BIOLOGY, Vol III, Green Publishing Associates, Inc., John Wiley & Sons, Inc., New York, at pp. 13.12.1–13.12.5). Poly(A)$^+$ RNA can be selected, e.g., by selection with oligo-dT cellulose or, alternatively, by oligo-dT primed reverse transcription of total cellular RNA. In one embodiment, RNA can be fragmented by methods known in the art, e.g., by incubation with $ZnCl_2$, to generate fragments of RNA. In another embodiment, the polynucleotide molecules analyzed by the invention comprise cDNA, or PCR products of amplified RNA or cDNA.

In one embodiment, total RNA, mRNA, or nucleic acids derived therefrom, is isolated from a sample taken from a person afflicted with breast cancer. Target polynucleotide molecules that are poorly expressed in particular cells may be enriched using normalization techniques (Bonaldo et al., 1996, *Genome Res.* 6:791–806).

As described above, the target polynucleotides are detectably labeled at one or more nucleotides. Any method known in the art may be used to detectably label the target polynucleotides. Preferably, this labeling incorporates the label uniformly along the length of the RNA, and more preferably, the labeling is carried out at a high degree of efficiency. One embodiment for this labeling uses oligo-dT primed reverse transcription to incorporate the label; however, conventional methods of this method are biased toward generating 3' end fragments. Thus, in a preferred embodiment, random primers (e.g., 9-mers) are used in reverse transcription to uniformly incorporate labeled nucleotides over the full length of the target polynucleotides. Alternatively, random primers may be used in conjunction with PCR methods or T7 promoter-based in vitro transcription methods in order to amplify the target polynucleotides.

In a preferred embodiment, the detectable label is a luminescent label. For example, fluorescent labels, bioluminescent labels, chemiluminescent labels, and colorimetric labels may be used in the present invention. In a highly preferred embodiment, the label is a fluorescent label, such as a fluorescein, a phosphor, a rhodamine, or a polymethine dye derivative. Examples of commercially available fluorescent labels include, for example, fluorescent phosphoramidites such as FluorePrime (Amersham Pharmacia, Piscataway, N.J.), Fluoredite (Millipore, Bedford, Mass.), FAM (ABI, Foster City, Calif.), and Cy3 or Cy5 (Amersham Pharmacia, Piscataway, N.J.). In another embodiment, the detectable label is a radiolabeled nucleotide.

In a further preferred embodiment, target polynucleotide molecules from a patient sample are labeled differentially from target polynucleotide molecules of a standard. The standard can comprise target polynucleotide molecules from normal individuals (i.e., those not afflicted with breast cancer). In a highly preferred embodiment, the standard comprises target polynucleotide molecules pooled from samples from normal individuals or tumor samples from individuals having sporadic-type breast tumors. In another embodiment, the target polynucleotide molecules are derived from the same individual, but are taken at different time points, and thus indicate the efficacy of a treatment by a change in expression of the markers, or lack thereof, during and after the course of treatment (i.e., chemotherapy, radiation therapy or cryotherapy), wherein a change in the expression of the markers from a poor prognosis pattern to a good prognosis pattern indicates that the treatment is efficacious. In this embodiment, different timepoints are differentially labeled.

5.5.2.5 Hybridization to Microarrays

Nucleic acid hybridization and wash conditions are chosen so that the target polynucleotide molecules specifically bind or specifically hybridize to the complementary polynucleotide sequences of the array, preferably to a specific array site, wherein its complementary DNA is located.

Arrays containing double-stranded probe DNA situated thereon are preferably subjected to denaturing conditions to render the DNA single-stranded prior to contacting with the target polynucleotide molecules. Arrays containing single-stranded probe DNA (e.g., synthetic oligodeoxyribonucleic acids) may need to be denatured prior to contacting with the target polynucleotide molecules, e.g., to remove hairpins or dimers which form due to self complementary sequences.

Optimal hybridization conditions will depend on the length (e.g., oligomer versus polynucleotide greater than 200 bases) and type (e.g., RNA, or DNA) of probe and target nucleic acids. One of skill in the art will appreciate that as the oligonucleotides become shorter, it may become necessary to adjust their length to achieve a relatively uniform melting temperature for satisfactory hybridization results. General parameters for specific (i.e., stringent) hybridization conditions for nucleic acids are described in Sambrook et al., MOLECULAR CLONING—A LABORATORY MANUAL (2ND ED.), Vols. 1–3, Cold Spring Harbor Laboratory, Cold Spring Harbor, N.Y. (1989), and in Ausubel et al., CURRENT PROTOCOLS IN MOLECULAR BIOLOGY, vol. 2, Current Protocols Publishing, New York (1994). Typical hybridization conditions for the cDNA microarrays of Schena et al. are hybridization in 5×SSC plus 0.2% SDS at 65° C. for four hours, followed by washes at 25° C. in low stringency wash buffer (1×SSC plus 0.2% SDS), followed by 10 minutes at 25° C. in higher stringency wash buffer (0.1×SSC plus 0.2% SDS) (Schena et al., Proc. Natl. Acad. Sci. U.S.A. 93:10614 (1993)). Useful hybridization conditions are also provided in, e.g., Tijessen, 1993, HYBRIDIZATION WITH NUCLEIC ACID PROBES, Elsevier Science Publishers B. V.; and Kricka, 1992, NONISOTOPIC DNA PROBE TECHNIQUES, Academic Press, San Diego, Calif.

Particularly preferred hybridization conditions include hybridization at a temperature at or near the mean melting temperature of the probes (e.g., within 5° C., more preferably within 2° C.) in 1 M NaCl, 50 mM MES buffer (pH 6.5), 0.5% sodium sarcosine and 30% formamide.

5.5.2.6 Signal Detection and Data Analysis

When fluorescently labeled probes are used, the fluorescence emissions at each site of a microarray may be, preferably, detected by scanning confocal laser microscopy. In one embodiment, a separate scan, using the appropriate excitation line, is carried out for each of the two fluorophores used. Alternatively, a laser may be used that allows simultaneous specimen illumination at wavelengths specific to the two fluorophores and emissions from the two fluorophores can be analyzed simultaneously (see Shalon et al., 1996, "A DNA microarray system for analyzing complex DNA samples using two-color fluorescent probe hybridization," Genome Research 6:639–645, which is incorporated by reference in its entirety for all purposes). In a preferred embodiment, the arrays are scanned with a laser fluorescent scanner with a computer controlled X-Y stage and a microscope objective. Sequential excitation of the two fluorophores is achieved with a multi-line, mixed gas laser and the emitted light is split by wavelength and detected with two photomultiplier tubes. Fluorescence laser scanning devices are described in Schena et al., Genome Res. 6:639–645 (1996), and in other references cited herein. Alternatively, the fiber-optic bundle described by Ferguson et al., Nature Biotech. 14:1681–1684 (1996), may be used to monitor mRNA abundance levels at a large number of sites simultaneously.

Signals are recorded and, in a preferred embodiment, analyzed by computer, e.g., using a 12 or 16 bit analog to digital board. In one embodiment the scanned image is despeckled using a graphics program (e.g., Hijaak Graphics Suite) and then analyzed using an image gridding program that creates a spreadsheet of the average hybridization at each wavelength at each site. If necessary, an experimentally determined correction for "cross talk" (or overlap) between the channels for the two fluors may be made. For any particular hybridization site on the transcript array, a ratio of the emission of the two fluorophores can be calculated. The ratio is independent of the absolute expression level of the cognate gene, but is useful for genes whose expression is significantly modulated in association with the different breast cancer-related condition.

5.6 Computer-Facilitated Analysis

The present invention further provides for kits comprising the marker sets above. In a preferred embodiment, the kit contains a microarray ready for hybridization to target polynucleotide molecules, plus software for the data analyses described above.

The analytic methods described in the previous sections can be implemented by use of the following computer systems and according to the following programs and methods. A computer system comprises internal components linked to external components. The internal components of a typical computer system include a processor element interconnected with a main memory. For example, the computer system can be an Intel 8086-, 80386-, 80486-, Pentium™, or Pentium™-based processor with preferably 32 MB or more of main memory. The computer system may also be a Macintosh or a Macintosh-based system, but may also be a minicomputer or mainframe.

The external components may include mass storage. This mass storage can be one or more hard disks (which are typically packaged together with the processor and memory). Such hard disks are preferably of 1 GB or greater storage capacity. Other external components include a user interface device, which can be a monitor, together with an inputting device, which can be a "mouse", or other graphic input devices, and/or a keyboard. A printing device can also be attached to the computer.

Typically, a computer system is also linked to network link, which can be part of an Ethernet link to other local computer systems, remote computer systems, or wide area communication networks, such as the Internet. This network link allows the computer system to share data and processing tasks with other computer systems.

Loaded into memory during operation of this system are several software components, which are both standard in the art and special to the instant invention. These software components collectively cause the computer system to function according to the methods of this invention. These software components are typically stored on the mass storage device. A software component comprises the operating system, which is responsible for managing computer system and its network interconnections. This operating system can be, for example, of the Microsoft Windows® family, such as Windows 3.1, Windows 95, Windows 98, Windows 2000, or Windows NT, or may be of the Macintosh OS family, or may be UNIX or an operating system specific to a minicomputer or mainframe. The software component represents common languages and functions conveniently present on this system to assist programs implementing the methods specific to this invention. Many high or low level computer languages can be used to program the analytic methods of this invention. Instructions can be interpreted during run-time or compiled. Preferred languages include C/C++, FORTRAN and JAVA. Most preferably, the methods of this invention are programmed in mathematical software packages that allow symbolic entry of equations and high-level specification of processing, including some or all of the algorithms to be used, thereby freeing a user of the need to procedurally program individual equations or algorithms. Such packages include Mathlab from Mathworks (Natick, Mass.), MATHEMATICA® software package from Wolfram Research (Champaign, IL), or S-PLUS® software package from Math Soft (Cambridge, Mass.). Specifically, the software component includes the analytic methods of the invention as programmed in a procedural language or symbolic package.

The software to be included with the kit comprises the data analysis methods of the invention as disclosed herein. In particular, the software may include mathematical routines for marker discovery, including the calculation of similarity values between clinical categories (e.g., ER status) and marker expression. The software may also include mathematical routines for calculating the similarity between sample marker expression and control marker expression, using array-generated fluorescence data, to determine the clinical classification of a sample.

Additionally, the software may also include mathematical routines for determining the prognostic outcome, and recommended therapeutic regimen, for a particular breast cancer patient. Such software would include instructions for the computer system's processor to receive data structures that include the level of expression of five or more of the marker genes listed in Table 5 in a breast cancer tumor sample obtained from the breast cancer patient; the mean level of expression of the same genes in a control or template; and the breast cancer patient's clinical information, including lymph node and ER status. The software may additionally include mathematical routines for transforming the hybridization data and for calculating the similarity between the expression levels for the marker genes in the patient's breast cancer tumor sample and the control or template. In a specific embodiment, the software includes mathematical routines for calculating a similarity metric, such as a coefficient of correlation, representing the similarity between the expression levels for the marker genes in the patient's breast cancer tumor sample and the control or template, and expressing the similarity as that similarity metric.

The software would include decisional routines that integrate the patient's clinical and marker gene expression data, and recommend a course of therapy. In one embodiment, for example, the software causes the processor unit to receive expression data for the patient's tumor sample, calculate a metric of similarity of these expression values to the values for the same genes in a template or control, compare this similarity metric to a pre-selected similarity metric threshold or thresholds that differentiate prognostic groups, assign the patient to the prognostic group, and, on the basis of the prognostic group, assign a recommended therapeutic regimen. In a specific example, the software additionally causes the processor unit to receive data structures comprising clinical information about the breast cancer patient. In a more specific example, such clinical information includes the patient's age, stage of breast cancer, estrogen receptor status, and lymph node status.

Where the control is an expression template comprising expression values for marker genes within a group of breast cancer patients, the control can comprise either hybridization data obtained at the same time (i.e., in the same hybridization experiment) as the patient's individual hybridization data, or can be a set of hybridization or marker expression values stores on a computer, or on computer-readable media. If the latter is used, new patient hybridization data for the selected marker genes, obtained from initial or follow-up tumor samples, or suspected tumor samples, can be compared to the stored values for the same genes without the need for additional control hybridizations. However, the software may additionally comprise routines for updating the control data set, i.e., to add information from additional breast cancer patients or to remove existing members of the control data set, and, consequently, for recalculating the average expression level values that comprise the template. In another specific embodiment, said control comprises a set of single-channel mean hybridization intensity values for each of said at least five of said genes, stored on a computer-readable medium.

Clinical data relating to a breast cancer patient, and used by the computer program products of the invention, can be contained in a database of clinical data in which information on each patient is maintained in a separate record, which record may contain any information relevant to the patient, the patient's medical history, treatment, prognosis, or participation in a clinical trial or study, including expression profile data generated as part of an initial diagnosis or for tracking the progress of the breast cancer during treatment.

Thus, one embodiment of the invention provides a computer program product for classifying a breast cancer patient according to prognosis, the computer program product for use in conjunction with a computer having a memory and a processor, the computer program product comprising a computer readable storage medium having a computer program mechanism encoded thereon, wherein said computer program product can be loaded into the one or more memory units of a computer and causes the one or more processor units of the computer to execute the steps of (a) receiving a first data structure comprising the level of expression of at least five of the genes for which markers are listed in Table 5 in a cell sample taken from said breast cancer patient; (b) determining the similarity of the level of expression of said at least five genes to control levels of expression of said at least five genes to obtain a patient similarity value; (c) comparing said patient similarity value to selected first and second threshold values of similarity of said level of expression of said genes to said control levels of expression to obtain first and second similarity threshold values, respectively, wherein said second similarity threshold indicates greater similarity to said control levels of expression than does said first similarity threshold; and (d) classifying said breast cancer patient as having a first prognosis if said patient similarity value exceeds said first and said second threshold similarity values, a second prognosis if said patient similarity value exceeds said first threshold similarity value but does not exceed said second threshold similarity value, and a third prognosis if said patient similarity value does not exceed said first threshold similarity value or said second threshold similarity value. In a specific embodiment of said computer program product, said first threshold value of similarity and said second threshold value of similarity are values stored in said computer. In another more specific embodiment, said first prognosis is a "very good prognosis," said second prognosis is an "intermediate prognosis," and said third prognosis is a "poor prognosis," and wherein said computer program mechanism may be loaded into the memory and further cause said one or more processor units of said computer to execute the step of assigning said breast cancer patient a therapeutic regimen comprising no adjuvant chemotherapy if the patient is lymph node negative and is classified as having a good prognosis or an intermediate prognosis, or comprising chemotherapy if said patient has any other combination of lymph node status and expression profile. In another specific embodiment, said computer program mechanism may be loaded into the memory and further cause said one or more processor units of the computer to execute the steps of receiving a data structure comprising clinical data specific to said breast cancer patient. In a more specific embodiment, said clinical data includes the lymph node and estrogen receptor (ER) status of said breast cancer patient. In more specific embodiment, said single-channel hybridization intensity values are log transformed. The computer implementation of the method, however, may use any desired transformation method. In another specific embodiment, the computer program product causes said processing unit to perform said comparing step (c) by calculating the difference between the level of expression of each of said genes in said cell sample taken from said breast cancer patient and the level of expression of the same genes in said control. In another specific embodiment, the computer program product causes said processing unit to perform said comparing step (c) by calculating the mean log level of expression of each of said genes in said control to obtain a control mean log expression level for each gene, calculating the log expression level for each of said genes in a breast cancer sample from said breast cancer patient to obtain a patient log expression level, and calculating the difference between the patient log expression level and the control mean log expression for each of said genes. In another specific embodiment, the computer program product causes said processing unit to perform said comparing step (c) by calculating similarity between the level of expression of each of said genes in said cell sample taken from said breast cancer patient and the level of expression of the same genes in said control, wherein said similarity is expressed as a similarity value. In more specific embodiment, said similarity value is a correlation coefficient. The similarity value may, however, be expressed as any art-known similarity metric.

In an exemplary implementation, to practice the methods of the present invention, a user first loads experimental data into the computer system. These data can be directly entered by the user from a monitor, keyboard, or from other computer systems linked by a network connection, or on removable storage media such as a CD-ROM, floppy disk (not illustrated), tape drive (not illustrated), ZIP® drive (not illustrated) or through the network. Next the user causes execution of expression profile analysis software which performs the methods of the present invention.

In another exemplary implementation, a user first loads experimental data and/or databases into the computer system. This data is loaded into the memory from the storage media or from a remote computer, preferably from a dynamic geneset database system, through the network. Next the user causes execution of software that performs the steps of the present invention.

Additionally, because the data obtained and analyzed in the software and computer system products of the invention are confidential, the software and/or computer system comprises access controls or access control routines, such as Alternative computer systems and software for implementing the analytic methods of this invention will be apparent to one of skill in the art and are intended to be comprehended within the accompanying claims. In particular, the accompanying claims are intended to include the alternative program structures for implementing the methods of this invention that will be readily apparent to one of skill in the art.

6. EXAMPLES

Materials And Methods 117 tumor samples from breast cancer patients were collected. RNA samples were then prepared, and each RNA sample was profiled using inkjet-printed microarrays. Marker genes were then identified based on expression patterns; these genes were then used to train classifiers, which used these marker genes to classify tumors into diagnostic and prognostic categories. Finally, these marker genes were used to predict the diagnostic and prognostic outcome for a group of individuals.

1. Sample Collection 117 breast cancer patients treated at The Netherlands Cancer Institute/Antoni van Leeuwenhoek Hospital, Amsterdam, The Netherlands, were selected on the basis of the following clinical criteria (data extracted from the medical records of the NKI/AvL Tumor Register, Biometrics Department).

Group 1 (n=97, 78 for training, 19 for independent tests) was selected on the basis of: (1) primary invasive breast carcinoma <5 cm (T1 or T2); (2) no axillary metastases (N0); (3) age at diagnosis <55 years; (4) calender year of diagnosis 1983–1996; and (5) no prior malignancies (excluding carcinoma in situ of the cervix or basal cell carcinoma of the skin). All patients were treated by modified radical mastectomy (n=34) or breast conserving treatment (n=64), including axillary lymph node dissection. Breast conserving treatment consisted of excision of the tumor, followed by radiation of the whole breast to a dose of 50 Gy, followed by a boost varying from 15 to 25 Gy. Five patients received adjuvant systemic therapy consisting of chemotherapy (n=3) or hormonal therapy (n=2), all other patients did not receive additional treatment. All patients were followed at least annually for a period of at least 5 years. Patient follow-up information was extracted from the Tumor Registry of the Biometrics Department.

Group 2 (n=20) was selected as: (1) carriers of a germline mutation in BRCA1 or BRCA2; and (2) having primary invasive breast carcinoma. No selection or exclusion was made based on tumor size, lymph node status, age at diagnosis, calender year of diagnosis, other malignancies. Germline mutation status was known prior to this research protocol.

Information about individual from which tumor samples were collected include: year of birth; sex; whether the individual is pre- or post-menopausal; the year of diagnosis; the number of positive lymph nodes and the total number of nodes; whether there was surgery, and if so, whether the surgery was breast-conserving or radical; whether there was radiotherapy, chemotherapy or hormonal therapy. The tumor was graded according to the formula P=TNM, where T is the tumor size (on a scale of 0–5); N is the number of nodes that are positive (on a scale of 0–4); and M is metastases (0=absent, 1=present). The tumor was also classified according to stage, tumor type (in situ or invasive; lobular or ductal; grade) and the presence or absence of the estrogen and progesterone receptors. The progression of the cancer was described by (where applicable): distant metastases; year of distant metastases, year of death, year of last follow-up; and BRCA1 genotype.

2. Tumors:

Germline mutation testing of BRCA1 and BRCA2 on DNA isolated from peripheral blood lymphocytes includes mutation screening by a Protein Truncation Test (PTT) of exon 11 of BRCA1 and exon 10 and 11 of BRCA2, deletion PCR of BRCA1 genomic deletion of exon 13 and 22, as well Denaturing Gradient Gel Electrophoresis (DGGE) of the remaining exons. Aberrant bands were all confirmed by genomic sequencing analyzed on a ABI3700 automatic sequencer and confirmed on a independent DNA sample.

From all, tumor material was snap frozen in liquid nitrogen within one hour after surgery. Of the frozen tumor material an H&E (hematoxylin-eosin) stained section was prepared prior to and after cutting slides for RNA isolation. These H&E frozen sections ere assessed for the percentage of tumor cells; only samples with >50% tumor cells were selected for further study.

For all tumors, surgical specimens fixed in formaldehyde and embedded in paraffin were evaluated according to standard histopathological procedures. H&E stained paraffin sections were examined to assess tumor type (e.g., ductal or lobular according to the WHO classification); to assess histologic grade according the method described by Elston and Ellis (grade 1–3); and to assess the presence of lymphangio-invasive growth and the presence of an extensive lymphocytic infiltrate. All histologic factors were independently assessed by two pathologists (MV and JL); consensus on differences was reached by examining the slides together. A representative slide of each tumor was used for immunohistochemical staining with antibodies directed against the estrogen- and progesterone receptor by standard procedures. The staining result was scored as the percentage of positively staining nuclei (0%, 10%, 20%, etc., up to 100%).

3. Amplification, Labeling, and Hybridization

The outline for the production of marker-derived nucleic acids and hybridization of the nucleic acids to a microarray are outlined in FIG. 2. 30 frozen sections of 30 μM thickness were used for total RNA isolation of each snap frozen tumor specimen. Total RNA was isolated with RNAzol™ B (Campro Scientific, Veenendaal, The Netherlands) according to the manufacturers protocol, including homogenization of the tissue using a Polytron PT-MR2100 (Merck, Amsterdam, The Netherlands) and finally dissolved in RNAse-free $H_2O$. The quality of the total RNA was assessed by A260/A280 ratio and had to be between 1.7 and 2.1 as well as visual inspection of the RNA on an agarose gel which should indicate a stronger 28S ribosomal RNA band compared to the 18S ribosomal RNA band, subsequently, 25 μg of total RNA was DNase treated using the Qiagen RNASE-free DNase kit and RNeasy spin columns (Qiagen Inc, GmbH, Germany) according to the manufacturers protocol. DNase treated total RNA was dissolved in RNASE-free $H_2O$ to a final concentration of 0.2 μg/μl.

5 μg total RNA was used as input for cRNA synthesis. An oligo-dT primer containing a T7 RNA polymerase promoter sequence was used to prime first strand cDNA synthesis, and random primers (pdN6) were used to prime second strand cDNA synthesis by MMLV reverse transcriptase. This reaction yielded a double-stranded cDNA that contained the T7 RNA polymerase (T7RNAP) promoter. The double-stranded cDNA was then transcribed into cRNA by T7RNAP.

cRNA was labeled with Cy3 or Cy5 dyes using a two-step process. First, allylamine-derivatized nucleotides were enzymatically incorporated into cRNA products. For cRNA labeling, a 3:1 mixture of 5-(3-Aminoallyl)uridine 5'-triphosphate (Sigma) and UTP was substituted for UTP in the in vitro transcription (IVT) reaction. Allylamine-derivatized cRNA products were then reacted with N-hydroxy succinimide esters of Cy3 or Cy5 (CyDye, Amersham Pharmacia Biotech). 5 μg Cy5-labeled cRNA from one breast cancer patient was mixed with the same amount of Cy3-labeled product from a pool of equal amount of cRNA from each individual sporadic patient.

Microarray hybridizations were done in duplicate with fluor reversals. Before hybridization, labeled cRNAs were fragmented to an average size of 50–100nt by heating at 60° C. in the presence of 10 mM ZnCl2. Fragmented cRNAs were added to hybridization buffer containing 1 M NaCl, 0.5% sodium sarcosine and 50 mM MES, pH 6.5, which stringency was regulated by the addition of formamide to a final concentration of 30%. Hybridizations were carried out in a final volume of 3 ml at 40° C. on a rotating platform in a hybridization oven (Robbins Scientific) for 48 h. After hybridization, slides were washed and scanned using a confocal laser scanner (Agilent Technologies). Fluorescence intensities on scanned images were quantified, normalized and corrected.

4. Pooling of Samples

The reference cRNA pool was formed by pooling equal amount of cRNAs from each individual sporadic patient, for a total of 78 tumors.

5. 25 k Human Microarray

Surface-bound oligonucleotides were synthesized essentially as proposed by Blanchard et al., *Biosens. Bioelectron.* 6(7):687–690 (1996); see also Hughes et al., *Nature Biotech.* 19(4):342–347 (2000). Hydrophobic glass surfaces (3 inches by 3 inches) containing exposed hydroxyl groups were used as substrates for nucleotide synthesis. Phosphoramidite monomers were delivered to computer-defined positions on the glass surfaces using ink-jet printer heads. Unreacted monomers were then washed away and the ends of the extended oligonucleotides were deprotected. This cycle of monomer coupling, washing and deprotection was repeated for each desired layer of nucleotide synthesis. Oligonucleotide sequences to be printed were specified by computer files.

Microarrays containing approximately 25,000 human gene sequences (Hu25K microarrays) were used for this study. Sequences for microarrays were selected from RefSeq (a collection of non-redundant mRNA sequences, located on the Internet and Phil Green EST contigs, which is a collection of EST contigs assembled by Dr. Phil Green et al at the University of Washington (Ewing and Green, Nat. Genet. 25(2):232–4 (2000)), available on the Internet. Each mRNA or EST contig was represented on Hu25K microarray by a single 60mer oligonucleotide essentially as described in Hughes et al., *Nature Biotech.* 19(4):342–347 and in International Publication WO 01/06013, published Jan. 25, 2001, and in International Publication WO 01/05935, published Jan. 25, 2001, except that the rules for oligo screening were modified to remove oligonucleotides with more than 30% C or with 6 or more contiguous C residues.

Example 1

Differentially Regulated Gene Sets and Overall Expression Patterns of Breast Cancer Tumors Of the approximately 25,000 sequences represented on the microarray, a group of approximately 5,000 genes that were significantly regulated across the group of samples was selected. A gene was determined to be significantly differentially regulated with cancer of the breast if it showed more than two-fold of transcript changes as compared to a sporadic tumor pool, and if the p-value for differential regulation (Hughes et al., *Cell* 102:109–126 (2000)) was less than 0.01 either upwards or downwards in at least five out of 98 tumor samples.

An unsupervised clustering algorithm allowed us to cluster patients based on their similarities measured over this set of ~5,000 significant genes. The similarity between two patients x and y is defined as $$S = 1 - \left[ \sum_{i=1}^{N_V} \frac{(x_i - \bar{x})}{\sigma_{x_i}} \frac{(y_i - \bar{y})}{\sigma_{y_i}} \bigg/ \sqrt{\sum_{i=1}^{N_V} \left(\frac{x_i - \bar{x}}{\sigma_{x_i}}\right)^2 \sum_{i=1}^{N_V} \left(\frac{y_i - \bar{y}}{\sigma_{y_i}}\right)^2} \right]$$ Equation (5)

In Equation (5), X and Y are two patients with components of log ratio $x_i$ and $y_i$, i=1, . . . , N=5,100. Associated with every value $x_i$ is error $\sigma_{x_i}$. The smaller the value $\sigma_{x_i}$, the more reliable the measurement $$x_i \cdot \bar{x} = \sum_{i=1}^{N_V} \frac{x_i}{\sigma_{x_i}^2} \bigg/ \sum_{i=1}^{N_V} \frac{1}{\sigma_{x_i}^2}$$

is the error-weighted arithmetic mean.

The use of correlation as similarity metric emphasizes the importance of co-regulation in clustering rather than the amplitude of regulations.

The set of approximately 5,000 genes can be clustered based on their similarities measured over the group of 98 tumor samples. The similarity between two genes was defined in the same way as in Equation (1) except that now for each gene, there are 98 components of log ratio measurements.

The result of such a two-dimensional clustering is displayed in FIG. 3. Two distinctive patterns emerge from the clustering. The first pattern consists of a group of patients in the lower part of the plot whose regulations are very different from the sporadic pool. The other pattern is made of a group of patients in the upper part of the plot whose expressions are only moderately regulated in comparison with the sporadic pool. These dominant patterns suggest that the tumors can be unambiguously divided into two distinct types based on this set of ~5,000 significant genes.

To help understand these patterns, they were associated with estrogen-receptor (ER), proestrogen receptor (PR), tumor grade, presence of lymphocytic infiltrate, 2 and angio-invasion (FIG. 3). The lower group in FIG. 3, which features the dominant pattern, consists of 36 patients. Of the 39 ER-negative patients, 34 patients are clustered together in this group. From FIG. 4, it was observed that the expression of estrogen receptor alpha gene ESR1 and a large group of co-regulated genes are consistent with this expression pattern.

From FIG. 3 and FIG. 4, it was concluded that gene expression patterns can be used to classify tumor samples into subgroups of diagnostic interest. Thus, genes co-regulated across 98 tumor samples contain information about the molecular basis of breast cancers. The combination of clinical data and microarray measured gene abundance of ESR1 demonstrates that the distinct types are related to, or at least are reported by, the ER status.

Example 2

Identification of Genetic Markers Distinguishing Estrogen Receptor (+) From Estrogen Receptor (−) Patients The results described in this Example allow the identification of expression marker genes that differentiate two major types of tumor cells: "ER-negative" group and "ER-positive" group. The differentiation of samples by ER(+) status was accomplished in our steps: (1) identification of a set of candidate marker genes that correlate with ER level; 2) rank-ordering these candidate genes by strength of correlation; (3) optimization of the number of marker genes; and (4) classifying samples based on these marker genes.

1. Selection of Candidate Discriminating Genes

In the first step, a set of candidate discriminating genes was identified based on gene expression data of training samples. Specifically, we calculated the correlation coefficients $\rho$ between the category numbers or ER level and logarithmic expression ratio $\vec{r}$ across all the samples for each individual gene:

$$\rho = (\vec{c} \cdot \vec{r})/(\|\vec{c}\| \cdot \|\vec{r}\|) \quad \text{Equation (2)}$$

The histogram of resultant correlation coefficients is shown in FIG. 5A as a gray line. While the amplitude of correlation or anti-correlation is small for the majority of genes, the amplitude for some genes is as great as 0.5. Genes whose expression ratios either correlate or anti-correlate well with the diagnostic category of interest are used as reporter genes for the category.

Genes having a correlation coefficient larger than 0.3 ("correlated genes") or less than −0.3 ("anti-correlated genes") were selected as reporter genes. The threshold of 0.3 was selected based on the correlation distribution for cases where there is no real correlation (one can use permutations to determine this distribution). Statistically, this distribution width depends upon the number of samples used in the correlation calculation. The distribution width for control cases (no real correlation) is approximately $1/\sqrt{n-3}$, where n=the number of samples. In our case, n=98. Therefore, a threshold of 0.3 roughly corresponds to 3−σ in the distribution ($3 \times 1/\sqrt{n-3}$).

2,460 such genes were found to satisfy this criterion. In order to evaluate the significance of the correlation coefficient of each gene with the ER level, a bootstrap technique was used to generate Monte-Carlo data that randomize the association between gene expression data of the samples and their categories. The distribution of correlation coefficients obtained from one Monte-Carlo trial is shown as a dashed line in FIG. 5A. To estimate the significance of the 2,460 marker genes as a group, 10,000 Monte-Carlo runs were generated. The collection of 10,000 such Monte-Carlo trials forms the null hypothesis. The number of genes that satisfy the same criterion for Monte-Carlo data varies from run to run. The frequency distribution from 10,000 Monte-Carlo runs of the number of genes having correlation coefficients of >0.3 or <−0.3 is displayed in FIG. 5B. Both the mean and maximum value are much smaller than 2,460. Therefore, the significance of this gene group as the discriminating gene set between ER(+) and ER(−) samples is estimated to be greater than 99.99%.

2. Rank-Ordering of Candidate Discriminating Genes

In the second step, genes on the candidate list were rank-ordered based on the significance of each gene as a discriminating gene. The markers were rank-ordered either by amplitude of correlation, or by using a metric similar to a Fisher statistic:

$$t = (<x_1> - <x_2>)/\sqrt{[\sigma_1^2(n_1-1) + \sigma_2^2(n_2-1)]/(n_1+n_2-1)(1/n_1+1/n_2)} \quad \text{Equation (3)}$$

In Equation (3), $<x_1>$ is the error-weighted average of log ratio within the ER(−), and $<x_2>$ is the error-weighted average of log ratio within the ER(+) group. $\sigma_1$ is the variance of log ratio within the ER(−) group and $n_1$ is the number of samples that had valid measurements of log ratios. $\sigma_2$ is the variance of log ratio within the ER(+) group and $n_2$ is the number of samples that had valid measurements of log ratios. The t-value in Equation (3) represents the variance-compensated difference between two means. The confidence level of each gene in the candidate list was estimated with respect to a null hypothesis derived from the actual data set using a bootstrap technique; that is, many artificial data sets were generated by randomizing the association between the clinical data and the gene expression data.

3. Optimization of the Number of Marker Genes

The leave-one-out method was used for cross validation in order to optimize the discriminating genes. For a set of marker genes from the rank-ordered candidate list, a classifier was trained with 97 samples, and was used to predict the status of the remaining sample. The procedure was repeated for each of the samples in the pool, and the number of cases where the prediction for the one left out is wrong or correct was counted.

The above performance evaluation from leave-one-out cross validation was repeated by successively adding more marker genes from the candidate list. The performance as a function of the number of marker genes is shown in FIG. 6. The error rates for type 1 and type 2 errors varied with the number of marker genes used, but were both minimal while the number of the marker genes is around 550. Therefore, we consider this set of 550 genes is considered the optimal set of marker genes that can be used to classify breast cancer tumors into "ER-negative" group and "ER-positive" group. FIG. 7 shows the classification of patients as ER(+) or ER(−) based on this 550 marker set. FIG. 8 shows the correlation of each tumor to the ER-negative template versus the correlation of each tumor to the ER-positive template.

4. Classification Based on Marker Genes

In the third step, a set of classifier parameters was calculated for each type of training data set based on either of the above ranking methods. A template for the ER(−) group ($\vec{z}_1$) was generated using the error-weighted log ratio average of the selected group of genes. Similarly, a template for ER(+) group (called $\vec{z}_2$) was generated using the error-weighted log ratio average of the selected group of genes. Two classifier parameters ($P_1$ and $P_2$) were defined based on either correlation or distance. P measures the similarity between one sample $\vec{y}$ and the ER(−) template $\vec{z}_1$ over this selected group of genes. $P_2$ measures the similarity between one sample $\vec{y}$ and the ER(+) template $\vec{z}_2$ over this selected group of genes. The correlation $P_i$ is defined as:

$$P_i = (\vec{z}_i \cdot \vec{y})/(\|\vec{z}_i\| \cdot \|\vec{y}\|) \quad \text{Equation (1)}$$

A "leave-one-out" method was used to cross-validate the classifier built based on the marker genes. In this method, one sample was reserved for cross validation each time the classifier was trained. For the set of 550 optimal marker genes, the classifier was trained with 97 of the 98 samples, and the status of the remaining sample was predicted. This procedure was performed with each of the 98 patients. The number of cases where the prediction was wrong or correct was counted. It was further determined that subsets of as few as ~50 of the 2,460 genes are able classify tumors as ER(+) or ER(−) nearly as well as using the total set.

In a small number of cases, there was disagreement between classification by the 550 marker set and a clinical classification. In comparing the microarray measured log ratio of expression for ESR1 to the clinical binary decision (negative or positive) of ER status for each patient, it was seen that the measured expression is consistent with the qualitative category of clinical measurements (mixture of two methods) for the majority of tumors. For example, two patients who were clinically diagnosed as ER(+) actually exhibited low expression of ESR1 from microarray measurements and were classified as ER negative by 550 marker genes. Additionally, 3 patients who were clinically diagnosed as ER(−) exhibited high expression of ESR1 from microarray measurements and were classified as ER(+) by the same 550 marker genes. Statistically, however, microarray measured gene expression of ESR1 correlates with the dominant pattens better than clinically determined ER status.

Example 3

Identification of Genetic Markers Distinguishing BRCA1 Tumors From Sporadic Tumors in Estrogen Receptor (−) Patients The BRCA1 mutation is one of the major clinical categories in breast cancer tumors. It was determined that of tumors of 38 patients in the ER(−) group, 17 exhibited the BRCA1 mutation, while 21 were sporadic tumors. A method was therefore developed that enabled the differentiation of the 17 BRCA1 mutation tumors from the 21 sporadic tumors in the ER(−) group.

1. Selection of candidate discriminating genes

In the first step, a set of candidate genes was identified based on the gene expression patterns of these 38 samples. We first calculated the correlation between the BRCA1-mutation category number and the expression ratio across all 38 samples for each individual gene by Equation (2). The distribution of the correlation coefficients is shown as a histogram defined by the solid line in FIG. 9A. We observed that, while the majority of genes do not correlate with BRCA1 mutation status, a small group of genes correlated at significant levels. It is likely that genes with larger correlation coefficients would serve as reporters for discriminating tumors of BRCA1 mutation carriers from sporadic tumors within the ER(−) group.

In order to evaluate the significance of each correlation coefficient with respect to a null hypothesis that such correlation coefficient could be found by chance, a bootstrap technique was used to generate Monte-Carlo data that randomizes the association between gene expression data of the samples and their categories. 10,000 such Monte-Carlo runs were generated as a control in order to estimate the significance of the marker genes as a group. A threshold of 0.35 in the absolute amplitude of correlation coefficients (either correlation or anti-correlation) was applied both to the real data and the Monte-Carlo data. Following this method, 430 genes were found to satisfy this criterion for the experimental data. The p-value of the significance, as measured against the 10,000 Monte-Carlo trials, is approximately 0.0048 (FIG. 9B). That is, the probability that this set of 430 genes contained useful information about BRCA1-like tumors vs sporadic tumors exceeds 99%.

2. Rank-Ordering of Candidate Discriminating Genes

In the second step, genes on the candidate list were rank-ordered based on the significance of each gene as a discriminating gene. Here, we used the absolute amplitude of correlation coefficients to rank order the marker genes.

3 Optimization of Discriminating Genes

In the third step, a subset of genes from the top of this rank-ordered list was used for classification. We defined a BRCA1 group template (called $\vec{z}_1$) by using the error-weighted log ratio average of the selected group of genes. Similarly, we defined a non-BRCA1 group template (called $\vec{z}_2$) by using the error-weighted log ratio average of the selected group of genes. Two classifier parameters (P1 and P2) were defined based on either correlation or distance. P1 measures the similarity between one sample Y and the BRCA1 template $\vec{z}_1$ over this selected group of genes. P2 measures the similarity between one sample $\vec{y}$ and the non-BRCA1 template $\vec{z}_2$ over this selected group of genes. For correlation, P1 and P2 were defined in the same way as in Equation (4).

The leave-one-out method was used for cross validation in order to optimize the discriminating genes as described in Example 2. For a set of marker genes from the rank-ordered candidate list, the classifier was trained with 37 samples the remaining one was predicted. The procedure was repeated for all the samples in the pool, and the number of cases where the prediction for the one left out is wrong or correct was counted.

To determine the number of markers constituting a viable subset, the above performance evaluation from leave-one-out cross validation was repeated by cumulatively adding more marker genes from the candidate list. The performance as a function of the number of marker genes is shown in FIG. 10. The error rates for type 1 (false negative) and type 2 (false positive) errors (Bendat & Piersol, RANDOM DATA ANALYSIS AND MEASUREMENT PROCEDURES, 2D ED., Wiley Interscience, p. 89) reached optimal ranges when the number of the marker genes is approximately 100. Therefore, a set of about 100 genes is considered to be the optimal set of marker genes that can be used to classify tumors in the ER(−) group as either BRCA1-related tumors or sporadic tumors.

The classification results using the optimal 100 genes are shown in FIGS. 11A and 11B. As shown in FIG. 11A, the co-regulation patterns of the sporadic patients differ from those of the BRCA1 patients primarily in the amplitude of regulation. Only one sporadic tumor was classified into the BRCA1 group. Patients in the sporadic group are not necessarily BRCA1 mutation negative; however, it is estimated that only approximately 5% of sporadic tumors are indeed BRCA1-mutation carriers.

Example 4

Identification of Genetic Markers Distinguishing Sporadic Tumor Patients with >5 Year Versus <5 Year Survival Times 78 tumors from sporadic breast cancer patients were used to explore prognostic predictors from gene expression data. Of the 78 samples in this sporadic breast cancer group, 44 samples were known clinically to have had no distant metastases within 5 years since the initial diagnosis ("no distant metastases group") and 34 samples had distant metastases within 5 years since the initial diagnosis ("distant metastases group"). A group of 231 markers, and optimally a group of 70 markers, was identified that allowed differentiation between these two groups.

1. Selection of Candidate Discriminating Genes

In the first step, a set of candidate discriminating genes was identified based on gene expression data of these 78 samples. The correlation between the prognostic category number (distant metastases vs no distant metastases) and the logarithmic expression ratio across all samples for each individual gene was calculated using Equation (2). The distribution of the correlation coefficients is shown as a solid line in FIG. 12A. FIG. 12A also shows the result of one Monte-Carlo run as a dashed line. We observe that even though the majority of genes do not correlate with the prognostic categories, a small group of genes do correlate. It is likely that genes with larger correlation coefficients would be more useful as reporters for the prognosis of interest—distant metastases group and no distant metastases group.

In order to evaluate the significance of each correlation coefficient with respect to a null hypothesis that such correlation coefficient can be found by chance, we used a bootstrap technique to generate data from 10,000 Monte-Carlo runs as a control (FIG. 12B). We then selected genes that either have the correlation coefficient larger than 0.3 ("correlated genes") or less than −0.3 ("anti-correlated genes"). The same selection criterion was applied both to the real data and the Monte-Carlo data. Using this comparison, 231 markers from the experimental data were identified that satisfy this criterion. The probability of this gene set for discriminating patients between the distant metastases group and the no distant metastases group being chosen by random fluctuation is approximately 0.003.

2. Rank-Ordering of Candidate Discriminating Genes

In the second step, genes on the candidate list were rank-ordered based on the significance of each gene as a discriminating gene. Specifically, a metric similar to a "Fisher" statistic, defined in Equation (3), was used for the purpose of rank ordering. The confidence level of each gene in the candidate list was estimated with respect to a null hypothesis derived from the actual data set using the bootstrap technique. Genes in the candidate list can also be ranked by the amplitude of correlation coefficients.

3. Optimization of Discriminating Genes

In the third step, a subset of 5 genes from the top of this rank-ordered list was selected to use as discriminating genes to classify 78 tumors into a "distant metastases group" or a "no distant metastases group". The leave-one-out method was used for cross validation. Specifically, 77 samples defined a classifier based on the set of selected discriminating genes, and these were used to predict the remaining sample. This procedure was repeated so that each of the 78 samples was predicted. The number of cases in which predictions were correct or incorrect were counted. The performance of the classifier was measured by the error rates of type 1 and type 2 for this selected gene set.

We repeated the above performance evaluation procedure, adding 5 more marker genes each time from the top of the candidate list, until all 231 genes were used. As shown in FIG. 13, the number of mis-predictions of type 1 and type 2 errors change dramatically with the number of marker genes employed. The combined error rate reached a minimum when 70 marker genes from the top of our candidate list were used. Therefore, this set of 70 genes is the optimal, preferred set of marker genes useful for the classification of sporadic tumor patients into either the distant metastases or no distant metastases group. Fewer or more markers also act as predictors, but are less efficient, either because of higher error rates, or the introduction of statistical noise.

4. Reoccurrence Probability Curves

The prognostic classification of 78 patients with sporadic breast cancer tumors into two distinct subgroups was predicted based on their expression of the 70 optimal marker genes (FIGS. 14 and 15).

Figure 19B:
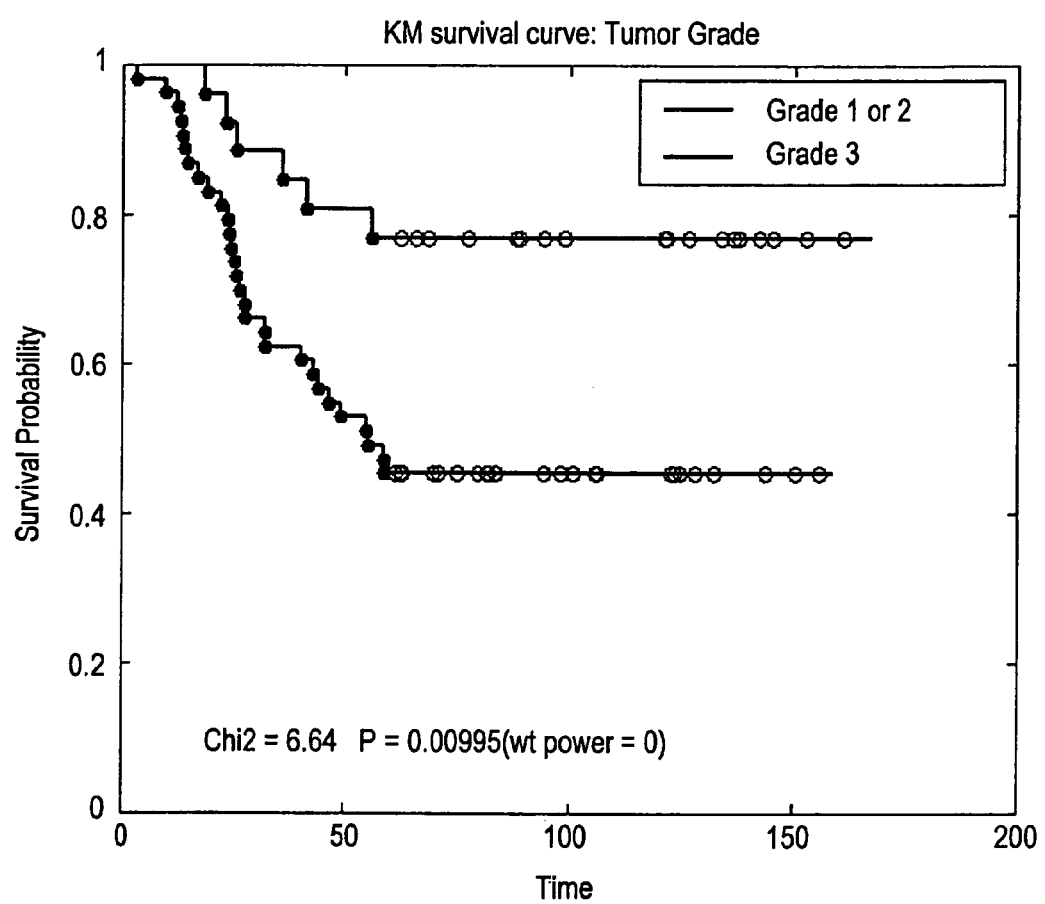

To evaluate the prognostic classification of sporadic patients, we predicted the outcome of each patient by a classifier trained by the remaining 77 patients based on the 70 optimal marker genes. FIG. 16 plots the distant metastases probability as a function of the time since initial diagnosis for the two predicted groups. The difference between these two reoccurrence curves is significant. Using the $\chi^2$ test (S-PLUS 2000 Guide to Statistics, vol. 2, MathSoft, p. 44), the p-value is estimated to be ~$10^{-9}$. The distant metastases probability as a function of the time since initial diagnosis was also compared between ER(+) and ER(−) individuals (FIG. 17), PR(+) and PR(−) individuals (FIG. 18), and between individuals with different tumor grades (FIGS. 19A, 19B). In comparison, the p-values for the differences between two prognostic groups based on clinical data are much less significant than that based on gene expression data, ranging from $10^{-3}$ to 1.

To parameterize the reoccurrence probability as a function of time since initial diagnosis, the curve was fitted to one type of survival model—"normal":

$$P=\alpha\times\exp(-t^2/\tau^2) \quad (4)$$

For fixed $\alpha=1$, we found that $\tau=125$ months for patients in the no distant metastases group and $\tau=36$ months for patients in the distant metastases group. Using tumor grades, we found $\tau=100$ months for patients with tumor grades 1 and 2 and $\tau=60$ for patients with tumor grade 3. It is accepted clinical practice that tumor grades are the best available prognostic predictor. However, the difference between the two prognostic groups classified based on 70 marker genes is much more significant than those classified by the best available clinical information.

5. Prognostic Prediction for 19 Independent Sporadic Tumors

To confirm the proposed prognostic classification method and to ensure the reproducibility, robustness, and predicting power of the 70 optimal prognostic marker genes, we applied the same classifier to 19 independent tumor samples from sporadic breast cancer patients, prepared separately at The Netherlands Cancer Institute (NKI). The same reference pool was used.

The classification results of 19 independent sporadic tumors are shown in FIG. 20. FIG. 20A shows the log ratio of expression regulation of the same 70 optimum marker genes. Based on our classifier model, we expected the misclassification of 19*(6+7)/78=3.2 tumors. Consistently, (1+3)=4 of 19 tumors were misclassified.

6. Clinical Parameters as a Group vs. Microarray Data—Results of Logistic Regression In the previous section, the predictive power of each individual clinical parameter was compared with that of the expression data. However, it is more meaningful to combine all the clinical parameters as a group, and then compare them to the expression data. This requires multi-variant modeling; the method chosen was logistic regression. Such an approach also demonstrates how much improvement the microarray approach adds to the results of the clinical data.

The clinical parameters used for the multi-variant modeling were: (1) tumor grade; (2) ER status; (3) presence or absence of the progestogen receptor (PR); (4) tumor size; (5) patient age; and (6) presence or absence of angioinvasion. For the microarray data, two correlation coefficients were used. One is the correlation to the mean of the good prognosis group (C1) and the other is the correlation to the mean of the bad prognosis group (C2). When calculating the correlation coefficients for a given patient, this patient is excluded from either of the two means.

The logistic regression optimizes the coefficient of each input parameter to best predict the outcome of each patient. One way to judge the predictive power of each input parameter is by how much deviance (similar to Chi-square in the linear regression, see for example, Hasomer & Lemeshow, APPLIED LOGISTIC REGRESSION, John Wiley & Sons, (2000)) the parameter accounts for. The best predictor should account for most of the deviance. To fairly assess the predictive power, each parameter was modeled independently. The microarray parameters explain most of the deviance, and hence are powerful predictors.

The clinical parameters, and the two microarray parameters, were then monitored as a group. The total deviance explained by the six clinical parameters was 31.5, and total deviance explained by the microarray parameters was 39.4. However, when the clinical data was modeled first, and the two microarray parameters added, the final deviance accounted for is 57.0.

The logistic regression computes the likelihood that a patient belongs to the good or poor prognostic group. FIGS. 21A and 21B show the sensitivity vs. (1-specificity). The plots were generated by varying the threshold on the model predicted likelihood. The curve which goes through the top left corner is the best (high sensitivity with high specificity). The microarray outperformed the clinical data by a large margin. For example, at a fixed sensitivity of around 80%, the specificity was ~80% from the microarray data, and ~65% from the clinical data for the good prognosis group. For the poor prognosis group, the corresponding specificities were ~80% and ~70%, again at a fixed sensitivity of 80%. Combining the microarray data with the clinical data further improved the results. The result can also be displayed as the total error rate as the function of the threshold in FIG. 21C. At all possible thresholds, the error rate from the microarray was always smaller than that from the clinical data. By adding the microarray data to the clinical data, the error rate is further reduced, as one can see in FIG. 21C.

Odds ratio tables can be created from the prediction of the logistic regression. The probability of a patient being in the good prognosis group is calculated by the logistic regression based on different combinations of input parameters (clinical and/or microarray). Patients are divided into the following four groups according to the prediction and the true outcome: (1) predicted good and truly good, (2) predicted good but truly poor, (3) predicted poor but truly good, (4) predicted poor and truly poor. Groups (1) & (4) represent correct predictions, while groups (2) & (3) represent mispredictions. The division for the prediction is set at probability of 50%, although other thresholds can be used. The results are listed in Table 8. It is clear from Table 8 that microarray profiling (Table 8.3 & 8.10) outperforms any single clinical data (Table 8.4–8.9) and the combination of the clinical data (Table 8.2). Adding the micro-array profiling in addition to the clinical data give the best results (Table 8.1).

For microarray profiling, one can also make a similar table (Table 8.11) without using logistic regression. In this case, the prediction was simply based on $C_1$-$C_2$ (greater than 0 means good prognosis, less than 0 mean poor prognosis).

TABLE 8.1

Prediction by clinical + microarray

| | Predicted good | Predicted poor |
|---|---|---|
| true good | 39 | 5 |
| true poor | 4 | 30 |

TABLE 8.2

Prediction by clinical alone

| | Predicted good | Predicted poor |
|---|---|---|
| true good | 34 | 10 |
| true poor | 12 | 22 |

TABLE 8.3

Prediction by microarray

| | predicted good | Predicted poor |
|---|---|---|
| true good | 39 | 5 |
| true poor | 10 | 24 |

TABLE 8.4

Prediction by grade

| | Predicted good | Predicted poor |
|---|---|---|
| true good | 23 | 21 |
| true poor | 5 | 29 |

TABLE 8.5

Prediction by ER

| | Predicted good | Predicted poor |
|---|---|---|
| true good | 35 | 9 |
| true poor | 21 | 13 |

TABLE 8.6

Prediction by PR

| | Predicted good | Predicted poor |
|---|---|---|
| true good | 35 | 9 |
| true poor | 18 | 16 |

TABLE 8.7

Prediction by size

| | Predicted good | Predicted poor |
|---|---|---|
| true good | 35 | 9 |
| true poor | 13 | 21 |

TABLE 8.8

Prediction by age

| | Predicted good | Predicted poor |
|---|---|---|
| true good | 33 | 11 |
| true poor | 15 | 19 |

TABLE 8.9

Prediction by angioinvasion

|  | Predicted good | Predicted poor |
|---|---|---|
| true good | 37 | 7 |
| true poor | 19 | 15 |

TABLE 8.10

Prediction by dC (C1–C2)

|  | Predicted good | Predicted poor |
|---|---|---|
| true good | 36 | 8 |
| true poor | 6 | 28 |

TABLE 8.11

No logistic regression, simply judged by C1–C2

|  | Predicted good | Predicted poor |
|---|---|---|
| true good | 37 | 7 |
| true poor | 6 | 28 |

Example 5

Concept of Mini-Array for Diagnosis Purposes

All genes on the marker gene list for the purpose of diagnosis and prognosis can be synthesized on a small-scale microarray using ink-jet technology. A microarray with genes for diagnosis and prognosis can respectively or collectively be made. Each gene on the list is represented by single or multiple oligonucleotide probes, depending on its sequence uniqueness across the genome. This custom designed mini-array, in combination with sample preparation protocol, can be used as a diagnostic/prognostic kit in clinics.

Example 6

Biological Significance of Diagnostic Marker Genes

The public domain was searched for the available functional annotations for the 430 marker genes for BRCA1 diagnosis in Table 3. The 430 diagnostic genes in Table 3 can be divided into two groups: (1) 196 genes whose expressions are highly expressed in BRCA1-like group; and (2) 234 genes whose expression are highly expressed sporadic group. Of the 196 BRCA1 group genes, 94 are annotated. Of the 234 sporadic group genes, 100 are annotated. The terms "T-cell", "B-cell" or "immunoglobulin" are involved in 13 of the 94 annotated genes, and in 1 of the 100 annotated genes, respectively. Of 24,479 genes represented on the microarrays, there are 7,586 genes with annotations to date. "T-cell", B-cell" and "immunoglobulin" are found in 207 of these 7,586 genes. Given this, the p-value of the 13 "T-cell", "B-cell" or "immunoglobulin" genes in the BRCA1 group is very significant (p-value=$1.1 \times 10^{-6}$). In comparison, the observation of 1 gene relating to "T-cell", "B-cell", or "immunoglobulin" in the sporadic group is not significant (p-value=0.18).

The observation that BRCA1 patients have highly expressed lymphocyte (T-cell and B-cell) genes agrees with what has been seen from pathology that BRCA1 breast tumor has more frequently associated with high lymphocytic infiltration than sporadic cases (Chappuis et al., 2000, *Semin Surg Oncol* 18:287–295).

Example 7

Biological Significance of Prognosis Marker Genes

A search was performed for available functional annotations for the 231 prognosis marker genes (Table 5). The markers fall into two groups: (1) 156 markers whose expressions are highly expressed in poor prognostic group; and (2) 75 genes whose expression are highly expressed in good prognostic group. Of the 156 markers, 72 genes are annotated; of the 75 genes, 28 genes are annotated.

Twelve of the 72 markers, but none of the 28 markers, are, or are associated with, kinases. In contrast, of the 7,586 genes on the microarray having annotations to date, only 471 involve kinases. On this basis, the p-value that twelve kinase-related markers in the poor prognostic group is significant (p-value =0.001). Kinases are important regulators of intracellular signal transduction pathways mediating cell proliferation, differentiation and apoptosis. Their activity is normally tightly controlled and regulated. Overexpression of certain kinases is well known involving in oncogenesis, such as vascular endothelial growth factor receptor1 (VEGFR1 or FLT1), a tyrosine kinase in the poor prognosis group, which lays a very important role in tumor angiogenesis. Interestingly, vascular endothelial growth factor (VEGF), VEGFR's ligand, is also found in the prognosis group, which means both ligand and receptor are upregulated in poor prognostic individuals by an unknown mechanism.

Likewise, 16 of the 72 markers, and only two of the 28 markers, are, or are associated with, ATP-binding or GTP-binding proteins. In contrast, of the 7,586 genes on the microarray having annotations to date, only 714 and 153 involve ATP-binding and GTP-binding, respectively. On this basis, the p-value that 16 GTP- or ATP-binding-related markers in the poor prognosis group is significant (p-value 0.001 and 0.0038). Thus, the kinase- and ATP— or GTP-binding-related markers within the 72 markers can be used as prognostic indicators.

Cancer is characterized by deregulated cell proliferation. On the simplest level, this requires division of the cell or mitosis. By keyword searching, we found "cell division" or "mitosis" included in the annotations of 7 genes respectively in the 72 annotated markers from the 156 poor prognosis markers, but in none for the 28 annotated genes from 75 good prognosis markers. Of the 7,586 microarray markers with annotations, "cell division" is found in 62 annotations and "mitosis" is found in 37 annotations. Based on these findings, the p-value that seven cell division- or mitosis-related markers are found in the poor prognosis group is estimated to be highly significant (p-value=$3.5 \times 10^{-5}$). In comparison, the absence of cell division- or mitosis-related markers in the good prognosis group is not significant (p-value =0.69). Thus, the seven cell division- or mitosis-related markers may be used as markers for poor prognosis.

Example 8

Construction of an Artificial Reference Pool

The reference pool for expression profiling in the above Examples was made by using equal amount of cRNAs from each individual patient in the sporadic group. In order to have a reliable, easy-to-made, and large amount of reference pool, a reference pool for breast cancer diagnosis and prognosis can be constructed using synthetic nucleic acid representing, or derived from, each marker gene. Expression of marker genes for individual patient sample is monitored only against the reference pool, not a pool derived from other patients.

To make the reference pool, 60-mer oligonucleotides are synthesized according to 60-mer ink-jet array probe sequence for each diagnostic/prognostic reporter genes, then double-stranded and cloned into pBluescript SK-vector (Stratagene, La Jolla, Calif.), adjacent to the T7 promoter sequence. Individual clones are isolated, and the sequences of their inserts are verified by DNA sequencing. To generate synthetic RNAs, clones are linearized with EcoRI and a T7 in vitro transcription (IVT) reaction is performed according to the MegaScript kit (Ambion, Austin, Tex.). IVT is followed by DNase treatment of the product. Synthetic RNAs are purified on RNeasy columns (Qiagen, Valencia, Calif.). These synthetic RNAs are transcribed, amplified, labeled, and mixed together to make the reference pool. The abundance of those synthetic RNAs are adjusted to approximate the abundance of the corresponding marker-derived transcripts in the real tumor pool.

Example 9

Use of Single-Channel Data and a Sample Pool Represented by Stored Values

1. Creation of a Reference Pool of Stored Values ("Mathematical Sample Pool")

The use of ratio-based data used in Examples 1–7, above, requires a physical reference sample. In the above Examples, a pool of sporadic tumor sample was used as the reference. Use of such a reference, while enabling robust prognostic and diagnostic predictions, can be problematic because the pool is typically a limited resource. A classifier method was therefore developed that does not require a physical sample pool, making application of this predictive and diagnostic technique much simpler in clinical applications.

To test whether single-channel data could be used, the following procedure was developed. First, the single channel intensity data for the 70 optimal genes, described in Example 4, from the 78 sporadic training samples, described in the Materials and Methods, was selected from the sporadic sample vs. tumor pool hybridization data. The 78 samples consisted of 44 samples from patients having a good prognosis and 34 samples from patients having a poor prognosis. Next, the hybridization intensities for these samples were normalized by dividing by the median intensity of all the biological spots on the same microarray. Where multiple microarrays per sample were used, the average was taken across all of the microarrays. A log transform was performed on the intensity data for each of the 70 genes, or for the average intensity for each of the 70 genes where more than one microarray is hybridized, and a mean log intensity for each gene across the 78 sporadic samples was calculated. For each sample, the mean log intensities thus calculated were subtracted from the individual sample log intensity. This figure, the mean subtracted log(intensity) was then treated as the two color log(ratio) for the classifier by substitution into Equation (5). For new samples, the mean log intensity is subtracted in the same manner as noted above, and a mean subtracted log(intensity) calculated.

The creation of a set of mean log intensities for each gene hybridized creates a "mathematical sample pool" that replaces the quantity-limited "material sample pool." This mathematical sample pool can then be applied to any sample, including samples in hand and ones to be collected in the future. This "mathematical sample pool" can be updated as more samples become available.

2. Results

To demonstrate that the mathematical sample pool performs a function equivalent to the sample reference pool, the mean-subtracted-log(intensity) (single channel data, relative to the mathematical pool) vs. the log(ratio) (hybridizations, relative to the sample pool) was plotted for the 70 optimal reporter genes across the 78 sporadic samples, as shown in FIG. 22. The ratio and single-channel quantities are highly correlated, indicating both have the capability to report relative changes in gene expression. A classifier was then constructed using the mean-subtracted-log(intensity) following exactly the same procedure as was followed using the ratio data, as in Example 4.

As shown in FIGS. 23A and 23B, single-channel data was successful at classifying samples based on gene expression patterns. FIG. 23A shows samples grouped according to prognosis using single-channel hybridization data. The white line separates samples from patients classified as having poor prognoses (below) and good prognoses (above). FIG. 23B plots each sample as its expression data correlates with the good (open circles) or poor (filled squares) prognosis classifier parameter. Using the "leave-one-out" cross validation method, the classifier predicted 10 false positives out of 44 samples from patients having a good prognosis, and 6 false negatives out of 34 samples from patients having a poor prognosis, where a poor prognosis is considered a "positive." This outcome is comparable to the use of the ratio-based classifier, which predicted 7 out of 44, and 6 out of 34, respectively.

In clinical applications, it is greatly preferable to have few false negatives, which results in fewer under-treated patients. To conform the results to this preference, a classifier was constructed by ranking the patient sample according to its coefficient of correlation to the "good prognosis" template, and choosing a threshold for this correlation coefficient to allow approximately 10% false negatives, i.e., classification of a sample from a patient with poor prognosis as one from a patient with a good prognosis. Out of the 34 poor prognosis samples used herein, this represents a tolerance of 3 out of 34 poor prognosis patients classified incorrectly. This tolerance limit corresponds to a threshold 0.2727 coefficient of correlation to the "good prognosis" template. Results using this threshold are shown in FIGS. 24A and 24B. FIG. 24A shows single-channel hybridization data for samples ranked according to the coefficients of correlation with the good prognosis classifier; samples classified as "good prognosis" lie above the white line, and those classified as "poor prognosis" lie below. FIG. 24B shows a scatterplot of sample correlation coefficients, with three incorrectly classified samples lying to the right of the threshold correlation coefficient value. Using this threshold, the classifier had a false positive rate of 15 out of the 44 good prognosis samples. This result is not very different compared to the error rate of 12 out of 44 for the ratio based classifier.

In summary, the 70 reporter genes carry robust information about prognosis; the single channel data can predict the tumor outcome almost as well as the ratio based data, while being more convenient in a clinical setting.

Example 10

Comparison of Predictive Power of 70 Optimal Genes to Clinical Predictors and Development of Three Prognosis Categories

Using inkjet-synthesized oligonucleotide microarrays, we have defined a gene expression profile associated with prognosis in breast cancer. To identify this gene expression profile, tumors of less than 5 cm from lymph node negative patients younger than 55 years were used. Surprisingly, a 70 gene-based classifier outperformed all clinical parameters in predicting distant metastases within 5 years. The odds ratio for metastases of the "poor prognosis" versus "good prognosis" signature group based on the gene expression pattern was estimated to be approximately 15 by a cross-validation procedure. Even though these results were highly encouraging, a limitation of this first study was that these results were derived from and tested on two groups of patients which were selected for outcome: one group of patients who developed distant metastases within 5 years and one group of patients who remained disease-free for at least 5 years.

To provide a more accurate estimate of the risk of metastases associated with the prognosis signature and to further substantiate that the gene expression profile is a clinically meaningful tool, a cohort of 295 young breast cancer patients including both lymph node negative and positive patients was studied. The findings confirm that the prognosis profile is a more powerful predictor of disease outcome than currently used criteria.

1. Breast Tumor Selection Criteria

A consecutive series of 295 tumors was selected from The Netherlands Cancer Institute (NKI) fresh-frozen tissue bank according to the following patient selection criteria: primary invasive breast carcinoma less than 5 cm at pathologic examination (pTI or pT2); tumor-negative apical axillary lymph node as determined by a negative infraclavicular lymph node biopsy; age at diagnosis 52 years or younger; calendar year of diagnosis 1984–1995; and no prior malignancies. All patients had been treated by modified radical mastectomy or breast conserving surgery, including axillary lymph node dissection, followed by radiotherapy if indicated. The 295 tumor samples included 151 taken from lymph node negative (pathologic examination pN0) patients and 144 lymph node positive (pN+) patients. Ten of the 151 lymph node negative patients and 120 of the 144 lymph node positive patients had received adjuvant systemic therapy consisting of chemotherapy (n=90), hormonal therapy (n=20), or both (n=20). All patients were followed at least annually for a period of at least 5 years. Patient follow-up information was extracted from the NKI Medical Registry. Median follow-up of the 207 patients without metastases as first event was 7.8 years (range: 0.05–18.3) versus 2.7 years (0.3–14.0) for the 88 patients with metastasis as first event during follow-up. For all 295 patients median follow-up is 6.7 years (0.05–18.3). There were no missing data. This study was approved by the Medical Ethical Committee of the Netherlands Cancer Institute.

Clinicopathological parameters were determined as described in Materials and Methods, above. Estrogen receptor (ER) expression was estimated by hybridization intensity obtained from microarray experiments. Using this assay, it was determined that the cohort of 295 tumor samples includes 69 ER negative (ERα $\log_{10}$ intensity ratio below −0.65 units, corresponding to less than 10% nuclei with positive staining by immunohistochemistry) and 226 ER positive tumors. Histological grade was assessed using the method described by Elston and Ellis, *Histopathol.* 19(5): 403–410 (1991). Vascular invasion was assessed as none (−); minor (1–3 vessels; +/−); major (>3 vessels).

2. RNA Isolation and Microarray Expression Profiling

RNA isolation, cRNA labeling, the 25K oligonucleotide microarrays, and hybridization experiments were as described in Materials and Methods. The statistical error model that assigns p values to expression ratios was as described in Example 4. After hybridization, slides were washed and scanned using a confocal laser scanner (Agilent Technologies) (see Hughes et al., *Nat. Biotechnol.* 19(4): 342–347 (2001)).

3. Correlation of the Microarray Data with the Previously Determined Prognosis Profile The prognostic value of the gene expression profile in a consecutive series of breast cancer patients was determined using the 70 marker genes identified in the experiments described in Example 4. To acquire this consecutive series, 61 of the pN0 patients that were also part of the training series used for the construction of the 70-gene prognosis profile were also included. Leaving out these patients would have resulted in selection bias, because the first series contained a disproportionally large number of patients who developed distant metastases within 5 years. For each of the 234 new tumors in this 295 tumor sample cohort we calculated the correlation coefficient of the expression of the 70 genes with the previously determined average profile of these genes in tumors of good prognosis patients (C1) (see Example 4). A tumor with a correlation coefficient >0.4 (a threshold previously determined in the training set of 78 tumors that allowed 10% false negatives) was then assigned to the "good prognosis" signature group and all other tumors were assigned to the "poor prognosis" signature group. To avoid overfitting by the 61 previously used pN0 patients, the performance cross-validated correlation coefficients were used for the prognosis classification with a threshold correlation coefficient value of 0.55 (corresponding to the threshold for 10% false negatives of this cross-validated classifier).

4. Statistical Analysis

In the analysis of distant metastasis-free probabilities, patients whose first event was distant metastases were counted as failures; all other patients were censored at the date of their last follow-up, non-breast cancer death, local-regional recurrence or second primary malignancy, including contralateral breast cancer. Time was measured from the date of surgery. Metastasis-free curves were drawn using the method of Kaplan and Meier and compared using the log-rank test. Standard errors (SEs) of the metastasis-free percentages were calculated using the method of Tsiatis (Klein, *Scand. J of Statistics* 18:333–340 (1991)).

Proportional hazard regression analysis (Cox, *J. R. Statist. Soc. B* 34:187–220 (1972)) was used to adjust the association between the correlation coefficient C1 and metastases for other variables. SE's were calculated using the sandwich estimator (Lin and Wei, *J. Amer. Stat. Assoc.* 84:1074–1079 (1989)). Histological grade, vascular invasion and the number of axillary lymph node metastases (0 vs. 1–3 vs. ≧4) were used as variables. Linearity of the relation between ln (relative hazard) and tumor diameter, age and expression level of ER was tested using the Wald test for non-linear components of restricted cubic splines (Themeau et al., *Biometrika* 77:147–160 (1990)). No evidence for non-linearity was found (age: p=0.83, tumor diameter: p=0.75, number of positive nodes: p=0.65 and ER expression level: p=0.27). Non-proportionality of the hazard was tested using the Grambsch and Themeau method (Grambsch and Themeau, *Biometrika* 81:515–526 (1994)). In addition, for C1 the difference between the ln(hazard ratio) before and after 5 years of follow-up was tested using the Wald test. All calculations were done using the Splus2000 or Splus6 statistical package.

5. Prognosis Signature of 295 Breast Cancers

From each of the 295 tumors, total RNA was isolated and used to generate cRNA, which was labeled and hybridized to microarrays containing ~25,000 human genes (see Materials and Methods). Fluorescence intensities of scanned images were quantified and normalized to yield the transcript abundance of a gene as an intensity ratio as compared to a reference pool of cRNA made up of equal amounts of cRNA of all tumors combined. The gene expression ratios of the previously determined 70 prognosis marker genes for all 295 tumors in this study are shown in FIG. 25A. Tumors above (i.e., having a correlation coefficient greater than) the previously determined threshold (dotted line) were assigned to the "good prognosis" category (n=115); those below the line were assigned to the "poor prognosis" category (n=180). FIG. 25B displays the time to distant metastases as a first event (red dots) or the time of follow-up for all other patients (blue dots, see methods). FIG. 25C shows the lymph node status, distant metastases and survival for all 295 patients. By comparing FIGS. 25A, 25B, and 25C, it can be seen that there is a strong correlation between having the good prognosis signature and absence of (early) distant metastases or death. Lymph node negative and positive patients are evenly distributed, indicating that the prognosis profile is independent of lymph node status.

Table 9 summarizes the association between the prognosis profile and clinical parameters, which reveals that the prognosis profile is associated with histological grade, ER status and age, but not significantly with tumor diameter, vascular invasion, number of positive lymph nodes, or with treatment.

6. Prognostic Value of Gene Expression Signature

Distant metastasis-free probability and overall survival were calculated for all patients having tumors with either a "good" or "poor prognosis" signature (FIGS. 26A and 26B, Table 10). The resulting Kaplan-Meier curves showed a large difference in metastasis rate and overall survival between the "good prognosis" and "poor prognosis" signature patients. For metastasis as a first event, the hazard ratio (HR) for "poor" versus "good" signature over the whole follow-up period is estimated to be 5.1 (95% CI: 2.9–9.0; p<0.0001). The prognosis profile was even more significant for the first 5 years (HR 8.8; 95% CI: 3.8–20; p<0.0001) as compared to a HR of 1.8 (95% CI: 0.69–4.5; p=0.24) after 5 years. The HR for overall survival is 8.6 (95% CI: 4–19; p<0.0001).

The prognosis profile was first identified within a selected group of lymph node negative patients. Here, we wished to determine the performance of the prognostic signatures in both lymph node negative and positive patients. In the series of 151 lymph node negative patients (of the 295 patient cohort), the prognosis profile performed extremely well in predicting outcome of disease (FIGS. 26C, 26D; Table 10). For this group of patients, the HR for developing distant metastases is 5.5 (95% CT 2.5–12.2; p<0.0001). To validate our estimated odds ratio for metastases development within five years of our previous study (cross-validated odds ratio 15 (95% CI 4–56; p<0.0001), we calculated the odds ratio for 67 new pN0 patients, who were selected the same way as before (patients with either distant metastases within five years (n=12), or who remained disease-free with a follow-up for at least 5 years (n=55)). The odds ratio of the prognosis classifier for metastases within five years in this validation set is 15.3 (95% CI 1.9–125, p=0.011) (2×2 table, data not shown), in good agreement with our previous findings. These consistent performance results on two sets of tumors,

TABLE 9

Association of clinical parameters with the prognosis signature groups based on the expression of the preferred 70 prognostic marker genes.

| Variable | P-value* | Category | Poor signature (N = 180: 100%) Number of patients (%) | Good signature (N = 115: 100%) Number of patients (%) |
|---|---|---|---|---|
| Age | 0.0003 | <40 | 52 (29%) | 11 (10%) |
|  |  | 40–44 | 41 (23%) | 44 (38%) |
|  |  | 45–49 | 55 (31%) | 43 (37%) |
|  |  | ≥50 | 32 (18%) | 17 (15%) |
| Number pve nodes | 0.6 | 0 (pN0) | 91 (51%) | 60 (52%) |
|  |  | 37258 | 63 (35%) | 43 (37%) |
|  |  | ≥4 | 26 (14%) | 12 (10%) |
| Tumor diameter | 0.012 | ≤20 mm | 84 (47%) | 71 (62%) |
|  |  | ≥20 mm | 96 (53%) | 44 (38%) |
| Histologic grade | <0.0001 | I - Good | 19 (11%) | 56 (49%) |
|  |  | II - Intermediate | 56 (31%) | 45 (39%) |
|  |  | III - Poor | 105 (58%) | 14 (12%) |
| Vascular invasion | 0.38 | − | 108 (60%) | 77 (67%) |
|  |  | +/− | 18 (10%) | 12 (10%) |
|  |  | + | 54 (30%) | 26 (23%) |
| ER expression | <0.0001 | <−0.65 | 66 (37%) | 3 (3%) |
|  |  | ≥−0.65 | 114 (63%) | 112 (97%) |
| Surgery | 0.63 | BCT | 97 (54%) | 64 (56%) |
|  |  | Mastectomy | 83 (46%) | 51 (44%) |
| Chemotherapy | 0.79 | No | 114 (63%) | 71 (62%) |
|  |  | Yes | 66 (37%) | 44 (38%) |
| Hormonal therapy | 0.63 | No | 157 (87%) | 98 (85%) |
|  |  | Yes | 23 (13%) | 17 (15%) |

*Poor versus good profile.

highlight the value of the prognosis profile and the robustness of the profiling technology. Significantly, in the remaining group of 144 lymph node positive patients the prognosis profile was also strongly associated with outcome (FIGS. 26E, 26F, Table 10). Here, the hazard ratio for developing distant metastases is 4.5 (95% CI 2.0–10.2; p=0.0003).

TABLE 10

Percentages metastasis-free and overall survival for the prognosis signature groups

|  | 5 year distant metastasis free§ % (SE) | 10 year distant metastasis free§ % (SE) | 5 year survival % (SE) | 10 year survival % (SE) |
|---|---|---|---|---|
| All patients |  |  |  |  |
| Good signature (n = 115) | 94.7% (2.1) | 85.2% (4.3) | 97.4% (1.5%) | 94.5% (2.6%) |
| Poor signature (n = 180) | 60.5% (3.8) | 50.6% (4.5) | 74.1% (3.3%) | 54.6% (4.4%) |
| pN0 patients |  |  |  |  |
| Good signature (n = 60) | 93.4% (3.2%) | 86.8% (4.8%) | 96.7% (2.3%) | 96.7% (2.3%) |
| Poor signature (n = 91) | 56.2% (5.5%) | 44.1% (6.3%) | 71.5% (4.8%) | 49.6% (6.1%) |
| pN+ patients |  |  |  |  |
| Good signature (n = 55) | 95.2% (2.6) | 82.7% (7.8) | 98.2% (1.8%) | 92.0% (4.8%) |
| Poor signature (n = 89) | 66.3% (5.2) | 56.7% (6.4) | 76.5% (4.6%) | 59.5% (6.3%) |

§No distant metastasis as first failure.

7. Multivariable Analysis

Results from the multivariable analysis of distant metastases as first event including age, diameter, number of positive nodes, grade, vascular invasion, ER expression, treatment and the gene expression profile are shown in Table 11. The only independent predictive factors were the 70 gene expression profile, tumor diameter and adjuvant chemotherapy. During the period in which these patients were treated, the majority of premenopausal lymph node positive patients received adjuvant chemotherapy; lymph node negative patients usually did not receive adjuvant treatment. There was improved survival for patients who received adjuvant chemotherapy in this series of tumors. The 70 gene expression profile is by far the strongest predictor for distant metastases with an overall hazard ratio of 4.6 (95% CI: 2.3–9.2; p<0.0001). This is not unexpected, since the prognosis profile was established based on tumors from patients that all developed distant metastases within five years.

TABLE 11

Multivariable proportional hazard analysis for metastasis as first event of the prognosis profile in combination with clinicopathological variables.

| Variable | Unit | HR | 95% CI | P-value |
|---|---|---|---|---|
| Profile signature | Poor vs. good | 4.6 | 2.3–9.2 | <0.0001 |
| Age | per 10 years | 0.73 | 0.50–1.06 | 0.1 |
| No pve nodes | per pve node | 1.13 | 1.03–1.24 | 0.011 |
| Diameter | per cm | 1.56 | 1.22–2.0 | 0.0004 |
| Grade | Gr. 2 vs. Gr. 1 | 1.35 | 0.61–3.0 | 0.54 |
|  | Gr. 3 vs. Gr. 1 | 1.03 | 0.44–2.4 |  |
| Vasc. Invasion | ± vs − | 0.66 | 0.30–1.44 | 0.045 |
|  | + vs − | 1.65 | 0.98–2.8 |  |
| ER expression | per point | 0.86 | 0.56–1.31 | 0.48 |

TABLE 11-continued

Multivariable proportional hazard analysis for metastasis as first event of the prognosis profile in combination with clinicopathological variables.

| Variable | Unit | HR | 95% CI | P-value |
|---|---|---|---|---|
| Surgery | Mast. vs. BCT | 1.27 | 0.79–2.0 | 0.32 |
| Chemotherapy | Yes vs. No | 0.37 | 0.20–0.66 | 0.0008 |
| Hormone Treatment | Yes vs. No | 0.62 | 0.29–1.34 | 0.23 |

The prognosis profile is also a strong predictor of developing distant metastases within the group of lymph node positive patients (see FIGS. 26E, 26F). This is remarkable, since the presence of lymph node metastases by itself is a strong predictor of poor survival. Because most patients with lymph node positive breast cancer in our study received adjuvant chemotherapy or adjuvant hormonal therapy (120 out of 144 patients), it is not possible to give the prognostic value of the profile in untreated lymph node positive patients. There is, however, no indication that there is a difference in the prognostic value of the prognosis profile between patients who received adjuvant chemotherapy compared to those who did not (data not shown).

A key question is whether the prognosis profile is a more useful clinical tool to determine eligibility for adjuvant systemic treatment than the presently used "St. Gallen" and "NIH-consensus" criteria, which are based on histological and clinical characteristics (see Goldhirsch et al., Meeting Highlights: International Consensus Panel on the Treatment of Primary Breast Cancer, Seventh International Conference on Adjuvant Therapy of Primary Breast Cancer, *J. Clin. Oncol.* 19(18):3817–3827 (2001); Eifel et al., National Institutes of Health Consensus Development Conference Statement: Adjuvant Therapy for Breast Cancer, Nov. 1–3, 2000, *J. Natl. Cancer Inst.* 93(13):979–989 (2001)). FIG. 27 shows the Kaplan-Meier metastasis-free curves for the 151 lymph node negative patients, where the patients were classified as "good prognosis/low-risk" or "poor prognosis/high-risk" using the prognosis profile (FIG. 27A), the "St. Gallen" (FIG. 27B) or the "NIH-consensus" criteria (FIG. 27C).

Two major conclusions can be drawn from this comparison. First, the prognosis profile assigns many more pN0 patients to the low-risk group than the traditional methods (38% for "profile", versus 15% for "St. Gallen" and 7% for "NIH consensus"). Second, low-risk patients identified by expression profiling have better metastasis-free survival than those classified by "St. Gallen" or "NIH consensus" criteria. Conversely, patients classified as high-risk according to their expression profile tend to develop distant metastases more often than the high risk "St. Gallen" or "NIH consensus" patients. This indicates that both "St. Gallen" and "NIH" criteria misclassify a significant number of patients. Indeed, the high-risk group as defined by "NIH consensus" criteria contains a significant number of patients having a "good prognosis" signature and corresponding outcome (FIG. 27E). Conversely, the low-risk NIH group includes patients with a "poor prognosis" signature and outcome (FIG. 27G). Similar subgroups can be identified within the "St. Gallen" low- and high-risk patients (FIGS. 27D; 27F). Since both "St. Gallen" and "NIH" subgroups contain misclassified patients (who can be better identified through the prognosis signature), these patients are either over- or undertreated in present clinical practice.

Tumor size is a major parameter used in the "NIH-consensus" criteria for adjuvant therapy selection. However, the data above (see Table 9) show that the ability to develop distant metastases is only partially dependent on tumor size and suggest that metastatic capacity in many tumors is an early and inherent genetic property.

Figure 28E:
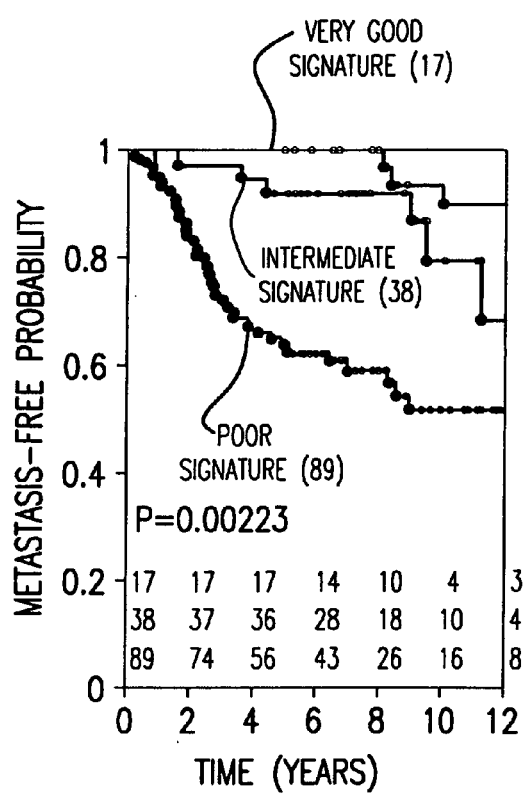
Figure 28F:
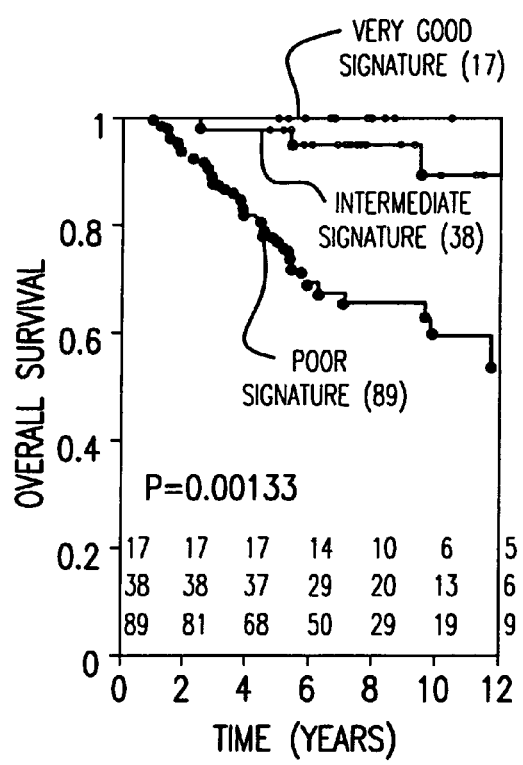

The "good prognosis groups" can be subdivided into two groups whose treatment regimens differ. The subgroups were determined by using another threshold in the correlation with the average profile of the good prognosis tumors. In the initial study that identified markers correlated with a good prognosis (see Example 4), we found that tumors having a correlation coefficient of greater than 0.636 (i.e., whose expression profiles correlated most strongly with the average expression profile of the "good prognosis" group) did not give rise to distant metastases. This was determined empirically for the 78 patient tumor samples by determining the correlation coefficient, in the ranked list, above which patients developed no distant metastases (data not shown). Thus, among the tumors previously identified as having a "good prognosis" signature, those that had a correlation coefficient exceeding 0.636 were classified as having a "very good prognosis" signature. These patients with such a "very good prognosis" signature in their tumor (FIGS. 28A–28F, upper line) have an even better outcome of disease than those having an "intermediate prognosis" signature (remaining "good prognosis" signature patients, correlation coefficient between 0.4 and 0.636, FIGS. 28A–28F, middle line). This is true for the entire cohort (FIGS. 28A, 28B) as well as the lymph node negative (FIGS. 28C, 28D) and positive patients separately (FIGS. 28E, 28F).

Together, our data indicate that the prognosis profile is a more accurate tool to select lymph node negative premenopausal patients for adjuvant systemic therapy than the presently used consensus criteria and may even be useful to guide adjuvant therapy in lymph node positive patients. We propose the following treatment regimens based upon the particular marker expression signature:

(1) Lymph node negative patients having a tumor with a "very good prognosis" signature can be treated without adjuvant systemic therapy.

(2) Lymph node negative patients having a tumor with an "intermediate prognosis" signature can be treated with adjuvant hormonal therapy only. As 97% of tumors having the "intermediate prognosis" signature are ER positive, this group of patients should benefit from adjuvant hormonal treatment. Adding chemotherapy to the treatment regimen of this patient group would result in only marginal survival benefit.

(3) All other patients should receive adjuvant chemotherapy. Where the tumor is ER+, hormonal therapy is also recommended.

Implementation of the use of the prognostic profile in breast cancer diagnostics should result in improved and patient-tailored adjuvant systemic treatment, reducing both over- and undertreatment.

7. REFERENCES CITED

All references cited herein are incorporated herein by reference in their entirety and for all purposes to the same extent as if each individual publication or patent or patent application was specifically and individually indicated to be incorporated by reference in its entirety for all purposes.

Many modifications and variations of the present invention can be made without departing from its spirit and scope, as will be apparent to those skilled in the art. The specific embodiments described herein are offered by way of example only, and the invention is to be limited only by the terms of the appended claims along with the full scope of equivalents to which such claims are entitled.

SEQUENCE LISTING (2699 sequences)

SEQ ID NO: 1 - DNA, 443 bp, Homo sapiens
tttttttttttttttccattaacccaacacaagtttatttactaagtcaagtcaaactgaggagtatttgtttctttggtagttggtagacaaagaatacatatacatattctatttcccattaagcattcgatcatgttacaaaacaatggcctagagaactatcattgaagatttaccaaatctgcctgaagcaaaatgtgataaactgcagaaatggtggagaatgacactggaagtcataaagttgattctcaaacacgggtttgaactgcataggaccgcttatatgcatattttgataaatatattgaaaatttttttggaaatttgcaacaatttaaaaaacttgcagatgcaccatgtagcttagaaatactgaaaaactaagaaaaaggtgtgtcatgaattcatataatatatgtagacactagtctatttta

SEQ ID NO: 2 - DNA, 3993 bp, Homo sapiens
gcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagaagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcagaaaaaaaaaaaaaaaaaaaaaaaaa

SEQ ID NO: 3 - DNA, 2358 bp, Homo sapiens
  Modified_base 2172: n = a,c,g, or t
attcggggcagcaacgcgcagaaggtggtgggcgcctcgggctcggggggcgcgggcccccaacccgatccggcgggcccggggggcgtcccggcgctggcggccgccgtcctgggcgcctgcgagccccgctgcgccgcgccctgtcccctgcccgcgctcagccgctgtcggggcgcggggtcgcgggggtcgcggggcgggcggggggcggcggggtccggggacgccgccgccgccgccgagtggatccggaagggcagcttcatccacaaacccgcgcacggctggctacaccccgacgccagggtcctggggcccggggtctcctacgtcgtgcggtacatgggctgcatcgaggttctccgctctatgcgctccctggactttaacacgcgcacgcaggtgaccagggaagccatcaaccggctccatgaggccgtgcctggcgtccggggatcctggaagaaaaaggcccccaacaaggccctggcgtccgtcctgggcaagagcaaccttcgctttgccggcatgagcatctccatccacatctccactgatggcctcagcctctccgtgcctgccacgcgccaggtcatcgccaaccaccacatgccgtccatctccttcgcgtcaggcggagacacggacatgacggattacgtggcctacgtcgccaaggaccccatcaaccagagagcctgccacatcctggagtgctgtgagggcctggcacagagcatcatcagcaccgtgggccaagctttcgagctacgcttcaagcagtacctgcacagcccgcccaaggtggcgctgcccccagaaaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccagggcccatctccttctctaagagatgcctgcagcctgccatgggacgtggggtccaccggtacagctccaccgggggacggctacgtgcaagcggacgcccggggccccccggaccacgaggagcacctgtatgtcaacacccagggtctggacgcccccgagccggaggacagccccaaaaaggatctgtttgacatgcgaccctttgaggatgccctgaagttgcatgagtgctcagtggcggcaggcgtgacagcagcccctcttcccttggaggaccagtggcccagcccccctacccgccgggcccctgtggcccccacggaggaacagctgcgtcaggagccctggtaccacggccggatgagccgccgggcggcagagaggatgcttcgagctgacggggacttccttgtgcgagacagcgtcaccaaccccgggcagtatgtcctcaccggcatgcacgccgggcagcccaagcacctgctgctcgtggaccccgagggcgtggtacggacgaaggacgtgctgtttgagagcatcagccacctgatcgaccaccacctgcagaacgggcagcccatcgtggccgccgagagtgagctgcacctgcgtggcgtggtctcacgggagccctgagccaggtgaccgttctcagccctggctcctgcctgttctcagccccagctcctgcctgtcatggccttggggctctcagccctcctcctggatcctggtcaggccgaaccaccgctgcctctccttcctccgcatgagcctctggcatggtccttcctccagctggccccgggctgggcagagcctcctcctgccggggcccctgcccaccccctcctttgcctggagtgagggtgttcataccaaagacggaaccatttcgcctttaaagaaaatatatccagaagcagccgctgcctcggagccctggcccgtgggtccccctctcgcctggctggttcggtctaacgccccggagagtcagagctcccaggaccctggggaggaggcggattccgggcctggctgggcttcctcttcccacctgaggactgggtgcacagttgtctttgaggggggacgcttaaggtgctttggggttctcaggccaggatacatgctggcgctgaagtgcaggcagccttgaggtcacctgggatctcggggtanccaggctgctccaagacagtggatatcgaggcagtcgtgaggcccctactccacctgggagcaggggaaggacgtggttgcctggcctgggctgcgcccagcagcttccccccaatcctgccctcccagctgtcgacccagatgggatgttcggatcggtttgtaattaaacctgggaatggccac

SEQ ID NO: 4 - DNA, 6629 bp, Homo sapiens
tggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggcccggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctggagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtttgtac

SEQ ID NO: 5 - DNA, 5956 bp, Homo sapiens
ggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagttccacctgcacacggcaccctggtgcctgatggtaataaggcaaaccattccagtcatcaggaagacacttacggagccctagactttgccttaagcaggactttggaaaatcctgtaaacgtgtacaacccgtcccattctgacagcctcgcttctcagcaaagtgttgccagtcatcccagacaatctgggcctggggcgcctaaccttgaccgtttttatcagcaggtcacgaaagatgcccagggccagcctggcctcgaaagagcccagcaggagctggcgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacgggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccctagttactgcagtgaatttctttcctgttgcagagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcac

SEQ ID NO: 6 - DNA, 6651 bp, Homo sapiens
ggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagcgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaatggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataagtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttctgaggagagaaacctaagatgggaagaattgacaaagttagataaggaagcgagacagagagaaagccagcagatgaaggagaaggctaaggagaaggactcaccgaaggagaagagtgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagccccaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgcttcaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcaggggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcacactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgagg

SEQ ID NO: 7 - DNA, 1270 bp, Homo sapiens
  Modified_base 1020, 1039, 1044, 1045, 1070, 1073, 1096, 1101, 1104, 1105, 1106,1118, 1125, 1127, 1131, 1134, 1149, 1155, 1157, 1166, 1169, 1177, 1178,1184, 1188, 1194, 1202, 1204, 1205, 1207, 1214, 1220, 1226, 1233, 1237,1239, 1250, 1254, 1260: n = a,c,g, or t
tcttttncaaggccagatctgttacagagtatcttttttctactacagaacatactgtagacagttattcagtggttaacttgtggaaataatcagaagatgcttttcacttttatgactggatatattttaatatttatcatattaagagaaacttaggttacttacagctcataaacgttgctatgaacatcattcatttattcacttatttatttttatggtgttcctagaaagaatttcctggactaaaggatttatgctttaaaaatattggtagttactgccaagaattgccatccagaaacagtgttagcccattccataaactccaacaacaaggtatgagagtgcctgtttcctcatatcctttgtgacaccggattttatcaagcttaaagttttttcattctaggtgggtgaaaatggtattccgttattgataatgtgtggaaatcaagttctaataagtttggggggaggttaattctttatatgtgctgtatgaattaatgccaactgtatgcctttgagagtgaaatcagaataatgtctctccactaaagcaggacttagagcactagttttccaaatgttgtctacagatggaaacactagcatcacctgggtactcgttagaaagtgcagattctctggcggtaccttagacctcctgaattaaaaactctgggggtagggttagacatttgtgttttaaacaagccctccaagtggtttcaatgcacattcaaagttgagaaccaatcactgatagagaaaaagcagcttgggtagaaacagttgattatttgcaaatttatattttaaaaagataggattcttaacagtaagctctttataattcaacaatgtgatctttactcctacccccgaaaaaactaatatgattttagtgtgtggtagctggatcgaaaacataataaatactcagatatggcggggangngnaggagcnnntnccaagaaaaaaaattcctgcggccgcaagggaattccacnggcccgccgttttaccaangttcnntgaactggggaaaaacccctgggcnttnaccccaactttaaatcccccctnggaaancannntcccccccttnccgccancntgggnttnatttaccaaaaaangccccncnccgaatccnccntccccaanntgttgncccnccctgnaagggcnaanngnaaatccnttggcangggcnggggtantttntnccggatttaccncanggccanttttggatcc

SEQ ID NO: 8 - DNA, 4103 bp, Homo sapiens
ggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcc

SEQ ID NO: 9 - DNA, 2979 bp, Homo sapiens
atcttgacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcctgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttt

SEQ ID NO: 10 - DNA, 6542 bp, Homo sapiens
ctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttatttaaaaaaacaaaaaacaaaaaaaatcaaaaaatcaaaaaaataataaacttcattttaaccttg

SEQ ID NO: 11 - DNA, 2077 bp, Homo sapiens
ccgagcgccagcgcggggaaccgggaaaaggaaaccgtgttgtgtacgtaagattcaggaaacgaaaccaggagccgcgggtgttggcgcaaaggttactcccagacccttttccggctgacttctgagaaggttgcgcacagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgt

SEQ ID NO: 12 - DNA, 439 bp, Homo sapiens
ctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtctt

SEQ ID NO: 13 - DNA, 7453 bp, Homo sapiens
acaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaactaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatggtctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcaactgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagttactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatatttc

SEQ ID NO: 14 - DNA, 4608 bp, Homo sapiens
gcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaagctggctgcctgcgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcagggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaac

SEQ ID NO: 15 - DNA, 6467 bp, Homo sapiens
aaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaatggaaggaaccacctgaattatatctgcaaacaaaatggaaatagttgttgaatagttccccaagctttactaagaagccttaatactctgtaaacaaacaaacaaacaaaaaacaaccttagcattaagaaataaaaacaaaaaacaagaagcaagttgtactgctagaaacttctctaagataagaggccaggccagtcagtttggcccagcaaacatgtgggtacttctccacctagggaagccactgaagatgagtttgacctgtggtgacctgacagagagaacattcagatcctcagattgcaccctgatgccctggtttaggaaagcagtgctttaaccttttgcccctggaaattactgattctttctgtgattagcagataccagaagggaaattatttaggattggcaatgtaaagagtattgaaggaacaacaaataacaatagcagaaataacagtgtgacataaagtgcccttccacctatttttctttggtttgcaacaccagcctgtagacttccagtttttcttaaattgaagagctccagacacttttgagcagggtttgtgaatagctttgaatgctttcctttggcttttcgtgaagacatatttccccagcctttcaactgtaaactcctttagtaccattgaaacttaaggcaaaaaagatccctgggattacttagccaaggcttaaatttatttttcaaagtcaagaacattagcctagaagtttttgctttgctagttaaagcttactttgcagagcttcccaaagtgaaagggaaactgaacttcacaattttgcacctggctttctggagccccattgcctgctcattcgtgtttttccccctgtaaattattttgcttttgaccaggttgtgctagaaagtagggctgcttctgtgagttctcagcctaggctgtggccactaagacgtgggtggggggatagacaggagtgagagggagagtgggtgacactttccgtgacacttaatgtaggaagacatgggcttctctctcttggcctcaagccacttttctggtccaaagaatattgggaaaactggattactttcagtatatttcttgagaccgggtcatctctgaaatgcatttggggtagtttcctggggtccaagggccaattcctatacccagtcctgcagtgtctgtgagctgtggaatgagagagaaaaccatggctgctcaggaaggaagtggagaatctctcagcacacgtagatccaaatctgtggcacctgctaaagattaggatttggagaggactcctctttggggttgtgaagaggaccttttccctctgttgttagcctgtagatccagaacggagcctgatgtgatgccttcactggttgatatattgcaaatagacactctgagccctgcattgcaagggcgtcttttgctttaaagaattcttagttttgccacaacagctcaaatctcagaataggatcaaaggcctagaaagactcctaaagtataggattacaaagactccaggaagcgtaagaaagagattgtgtttggagtcagatttcaatgtgaaacccatgccttacatttacacagcactttgtagtttgcaaattggtgtgttttcagccccctcccgctgccccatgctctgagatgattgtggattattacagtgaagtgcctggcccggagcccccagtgatgaagcaggaacttgagtctcaggactcccagcggctctctgcccatttcctcctctccgccccccacctcgcttcacctgttaccttgtgaagttgctgttggcacatagcccactaggaaaccaagaagtttgactgggagcgtgtgtttcattgcactgggcttagcatacggctggccctggtggctgtttggctaaattctccatttgaaacctaaagggccctctctgtgcttgagcacagtctcctcctagtggtcctgcctcaacctgctggcgggctgtctatggattggggtttcacctaatcatgctgtgtttcctttcttttctttctgtacattagactacttgggaggtgctgtgtgatccttggatgaaaaacatatatttaaagaaatggagagtgtttattttgtttgctttttgaggcatgtgctgtcaaatgttagagaccaaacttagtgattagaggttggtcctttgaccttcttctcttaattgcttttcatgtaatcatgataatttactcaggtagcactccagtcacaaacaatgtcacagagatgaaacagattcaaagaaaaaatatttttaagtcttttgaaaagaagtgctattcaaatttaagacatgtttaaattcataggtacattatctcttagtaagaaatacttttttttttctttttttagacagagtcttgctctgttgcccaggctggagtgcagtggcacgattttagctcactgcaacctctgcctccctggttgaagtgattctcctgcctcagcctcccgagtagctgggactacgcccggctaatttttatatttttagtagagaccggggtttaccatgttgcccaggctggtttcaaactcctgacctcaggtgatctgcctgcctctgcctcccagagtgctgggattacaggtgtgagccaccacacctggccgaaagacagtattttgatatagccacatacatgatttaatgagtaatgttaagtacagaaaagctgccatatccacatagttttagggggcatttcttcttcagtctaacaagaatatgatatccaattgtggttttccaatttatttctcttccaatttcttttgtatacctcacaggagaaattgaatcctagaactgggagatgactgccctgcccagggttttgtaatacataattgaaaataaaagtccctgaaactaaatgtttgcagcctgtatgaaatggactgtggaagggggataatttctctcctcacagaaagccactcgtctccttgaatgaggcattgagcagacacacgtttctctgtgtcgtggggcaggaagcaattcccttgcctcttcagcacatctcagttctttcccacatgaccccagaaccacatagaaaacattgaaaataatggattcttcattgtatttgaattttttttttttaacctttagcccaaaagggaagtgtgcctcgtggaaagagcaaatgccgtaaaatagaaaccaggagttttaatcgccatatattttaatgtgcttgcatgatgggaatgtgacttttagcactgcatggtgtttgggggcaagatattaatgtggaaatcttagcttaagttttactgtgctctcatcctgtgtcagctacccctctaaactgaaaaagaggcatggctcatttctctcctgctttatgtttttgaggttgacttgtaagataaaaataaaaataagaaaaaaatatatctaggcaaatgacatgaaaaaaaagttgaaatatactactggtgttcatttttgtcctgcagtgttgctttctcaaagaaataaacatgtggctggaagtgttt

SEQ ID NO: 16 - DNA, 5960 bp, Homo sapiens
cgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctgaaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtactttagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttcttt

SEQ ID NO: 17 - DNA, 4661 bp, Homo sapiens
gctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattcctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctg

SEQ ID NO: 18 - DNA, 4879 bp, Homo sapiens
gcccgggtgggtggctgcgcagggccctacctgggcgggagcggctgcagagccctgtccacgcggtgcctccccagcacggcacctcccactccaggctgttggttacctggccgggagctggcagagaccaggatttctcctcgccgccgttgctgttgttaggggaaacagaccatctgcatctagacctgcctctctctccgctccccacttcagacgagctcttcctgcctggaatctgtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgacgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaact

SEQ ID NO: 19 - DNA, 5932 bp, Homo sapiens
ggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcgcgtctgcttctgcgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttgtatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacagggctgctggtcaacctctccctcatcccagtcatgggcgggctggcgctgtgcacggccactgagatcagcttcaatgtcctggggttctcggccgcactgtccaccaacatcatggactgtttgcaaaatgttttttcaaaaaagctgctcagcggggacaaatacaggttctcggccccggagctgcagttctacaccagcgccgctgcggtggccatgctcgtcccggcccgggttttctttacggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcagcgtcgccagcaccgtgaaacatgccttgtccatctggctcagcgtaatcgttttcggcaacaagatcaccagcttgtcggccgttggcacagccctggtgaccgttggggtcctgctctacaacaaagccaggcaacaccagcaggaggcgctgcagagcctggctgcagccactggccgggccccagacgacacagtggagccgctgcttccacaggaccccaggcagcatccctgagagcaggaagctgccagctgctgctgtcctcgtgacactgcatcccccagaaatgggcagggacgccctcctccatggccctgctggggtgcaggacatggggagctaagttggccattgcctgcggctttctcggtttgtcggtgaagaccagcagaaactcaaactggggattccaggtatcagcttcctggagtagacaccagaccagtagctgactgtgtccgccgagcccatccccgtgtaatgtgaaaacagcctctgaggctcccatgctgggggtgcccacttcctctctgggcgacaccccagggtccaccgggagccagaggtgggtccagtgccaacgagagccgctccctgccacagccaagagagccctcggcttcccacaccagccatcgaaggccctgaggccctggaccggcggcagactggccctgggcatgaggccacagagcagggccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcatgagctccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttgctgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcaaccggcggattcccatgcccggtgcagcctgttgccagccagcctttgagacccagagctccagggcttgtcagaggcagcatggggctccagtggtcccgagtctcatttccctgcctgctctttaggcctttggcacccatggtcacttcactggttttccatttggcttctcacctgggaaatacaaaaatagcccctcctgaagataaaatcgttcagaaacagagcaataattctgactcattaacttctacctactcaaaaaagtctgccatgatgatggaccgaagtgaggctttttaacccacaagtaacctttttatttttttgagacggtcttgctctgtcacccaggctggagtgcagtggcatgatcttggctcgctgcagcctcgacttcctgggctcaagtgatccacctcagcctcccatgtggctggaaccgcaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccctgggtttccatttctttttttctgctttcctcaaaaactaatagaagaccggctgcggtagctcaggcctctagtcccagcactttgggaggctgcagatggcggatcacaaggccaggagttcgagaccagcctggccaacatgatgaaaccctgtctctaccaaaaatacaaaaattagctgggtgtgatggtgggtgcctgtggtctcagctactcaggaggctgaggcaggagaattgtttgagccccagaggcggaggttgcagtgagccaagatcgtgccattgcactccagcctgggcaacagggcaagattccgtctcaaaaacaaacactattagaaaatgctctggaggtggcggggagttgttgatttgtgaggacagattgaaagcaactcccagggtggccttgtccacctccccatcgagaatatggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaataggttgatttcctgtgtaacgctgctctggggcctcttcctcatcctggcagaaggagcctggagcccatgaggcagccagcactgtgcccttgctcagtcgtgctgtcccctccctctccctcagtctcttctccatgcccaagtcagtttccagccgctggtcttcatggcattcccagcacagctggacaccaagaggcaaaacccaaggcctggcttggccgtgttaacgattgtacagacatttttttaaataactttgtgtaatacttttctagaatagtaagttcttgttgaactgtcacagatgagcttctaggaacacaccgggtgtggttacttccactgggtgtgtccatggtcgtggtctgtgcctttgtaaacaaacagaacacttgaaccaccttccgaattgggtcatcggcttctttacattgatacttagagatttgcagctctctaactttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtttttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacgggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatgg

SEQ ID NO: 20 - DNA, 3558 bp, Homo sapiens
cagaagccgaaagaactgttcacatggagctgtttattttccggcctgaggttgccgagacaattggcgagctgtcttgaatatatctctatcaattaaaacagcagctgagataaataatgcacctttgccggaactgccacagggactgcaggctcaggcttctcaagccagctcaccgtccagctgagcgagatgtcagcccaaggaaggaacttagatgccttggaaattgatgcctcacagttattttctccagaggaggtgcagggtctgggctagggaaacggaaaggactctgttgcatttaataaagcctgtatcctatggcagcagccactaaggagctcaccagaataagccaatgccattcctcatttggcctgagcagctcagagtcaggaagtcagagcgcagaaaatccagcagctgtcagagggctccatgtttggccacggtctgaagcacctgttccacagccgccgtcggtctcgggaaagggagcaccagacgtctcaggattcccagcagcatcagcagcagcagggtatgtccgaccatgactccccagatgagaaggagcgctctccggagatgcatcgcgtctcctacgccatgtccctgcacgacctgcccgcccggcccaccgccttcaaccgcgtgctgcagcagatccgctcccggccctccatcaagcggggcgccagcctgcacagcagcagtgggggcggcagcagcgggagcagcagccggcgcaccaagagtagctccctggagccccagcgtggcagccctcacctgctgcgcaaggccccccaggacagcagcctggccgccatcctgcaccagcaccagtgccgtccccgctcttcctccaccaccgacactgctctgctgctggccgacggcagcaacgtgtacctcctggctgaggaggccgaaggcatcggggacaaggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcggagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggtggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtatgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggtttcctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaacc

SEQ ID NO: 21 - DNA, 6335 bp, Homo sapiens
cgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcaatggggtgctcagagcagcaggcaggttgggggaggggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcgggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaggcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgcaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagat

SEQ ID NO: 22 - DNA, 6740 bp, Homo sapiens
cccagttgtctgcgggctgcggggagctaagtccccagattggaggaggctggctctggtcttcgatgcacaggagtggccgttatggaacgcagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactcgaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctccatttgc

SEQ ID NO: 23 - DNA, 6827 bp, Homo sapiens
ctccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaagctctgcaagtgagtctggttctcaaagcacttgtgatccacttgtgactccaacagccctggctgcctgtaccagagttgactcctgctttaccccatggtttgtcccatccctttgcgtttctttccagtttgctcacctggaattccatctttgtcatcaccttgaccaactaggcacagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtgccatcttcaaacagttccattatttatgtctggtgcacagttttgactttagaacccaactctcaagtgcaacaacgaatgattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaagttatgtcagttctgcatttcctccatggtacagcaaggtatacaaattattcagattgaagacaagactacaataatcaataatacaccatatcaaatattttataaaccacagctatctgtctgcaatccccattctggaaaggagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccagggctatagtgctgacatatcaagaacacctcggagtgacttatttaaccctctcagaagaccctagtcctcgagtaattatccacaatagatgtccagtaaaaatgcttataaaggaaaacattaaagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggttgtgttcctgactggctttggctatgtgtatgtggatgttgtacatcagtgtggcacagtcttcatcactgtggccccagaaggaaaagcaggacctattttaaccaataccaacagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtattttacatggagctggactttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaatt

SEQ ID NO: 24 - DNA, 5117 bp, Homo sapiens
gctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggacggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgttttt

SEQ ID NO: 25 - DNA, 4745 bp, Homo sapiens
cttcagcaaacagaggacaaatcactcctgaaccaggggagcagctcagaggaggttgcagggagctcccagaagatgggccaaccaggaccctcaggagatagtgatttggctacagcactgcatcgccttagcttgcgtcgacaaaactatttaagtgagaagcagttctttgctgaagaatggcagcggaagatccaggttctggcagaccagaaggaaggagttagtggctgtgtcaccccgacagagagccttgcctctctctgcaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgacctcttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttttaaatttgtatttttatacaacctccaaaaaaaaaaacaactgggtagagggtgggagggatttacttttaagaggcaaaatgtgagtaaattgaaaccaagaaaacttgtttttagaatatttcgtctgaataagtacagtagccaaggaatacaaacataattgcatgtttttaaaaattccttggaggctggaaggggttaagccagaagtgcaatcaataggaattagggaatgttgtatatttatatatgtaaactttttttgtaagaaaagttggtgacaactaaaccaactttttccaaagtgcgctatgcatatttttaatgaaagatgacatgtatttgcacaaaaattctcaggcacattaaattattgtaaactgaagtaaaacccgggtgcttgctttgagattgtggttttttcttcctaatgtaaaataaaataaaacacatctgccttcttgatatttatagaattagagaataaactttttaatgggggagtcaaagctttttctttttctctaaggttctttttttttattcaaactgtatgaaatggcaaagtgaggctctggggttagatttcagcattcagcagttgacacaggctaagaaatggaaagaagtagatctgttttttctcaatgttgctgagcaaagtctgcttctcatcagatgacgtggctttgtctagacagcacgcagttcagaaagaaatgtctttatacaaaagacatgatagagaaaagatgagagaggggactaattattttgtttatgaaaatggcaagtaaattacttgatctttttggtgcttaatttgcaaatgttttgttcctttgtcctgacttaaaggcagttttctgaagaactcttgactcttgctcctatggttcccataggcacacctattcccaggccaaggagagtccttcctctccccttttgaggcatccccgccatccccccacttagagctatgtgctcaaaaagccaacatgaatgcagtggtaaaaatttgttagtttcttatactttttagaatctctcaataaaatttttctaaataaattccacaaaaacaaagggtgaagatggtctctccctttcgttccccttcactcagttgtgctgaggtcaatagagtgtagagtttcagaaaggattccagcaggtttatatgtgaatataagtgtccctgaatggggcaggcattaaatagaagaatccctgctgtttaaatttcccgcatattccaattcacttttaaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcatatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatctgacataaatgaatagactttggcaagggaggaaataagttaaaaggcagcttacaagagcctattccctataaagggtataattttacacagtactcaaagcttgttatcttttctgaccattttagtacagaattagtacttggtggttactaacatcaacttgtgacatctagaactagggctcttagtgtttagtgggccacttctctgatgtcagatgcatgcagacctgtactccacatgcaacccaacagcagtgcagtgtgataactgagcggtcgcatggcagaggacatccccctcagagtgggcacaagtgccctctagggcagccaggggaatactattgttcgatacctgggatttgactttgtcaaacagctctttgtgcccctatctttgttttgtcaaatgtagatcagttaataaacatgagtagcttgaattttc

SEQ ID NO: 26 - DNA, 5956 bp, Homo sapiens
caaagctcttgactcgctagctcagccccaacgcctgcatgaacttccggctacacgccattccgcttcccgaggaacgcttgggctgttgtacgggttccctacgggactctgaagactgaggatatccggcccggagcgtttgtgcggcgcggagttaagcgccccggcagtaacttaagggaagtggaccagggttgccgctgcccagagcggtcctttagtttccactggagtggagggaagagtgctgccatggcagcccctgcgcagcccaagaagatcgtggcccctacggtgtcccaaatcaatgcggagttcgtgacccagttagcatgtaaatactgggctccccacatcaagaagaaatcaccttttgatataaaggttattgaagatatatatgaaaaagagattgtcaaatcaaggtttgctattagaaagataatgctcttggaatttagccagtatcttgaaaattatctctggatgaattattctcctgaggtatctagcaaggcctatttaatgtcaatctgctgtatggtgaatgagaagtttagagaaaacgtgcctgcatgggagatttttaagaagaagccagaccacttcccattcttttttaaacacatcttgaaggcggcattagctgaaactgatggtgaattttcacttcatgaacagacagtcttactactttttcttgatcattgcttcaatagtttggaagtagacttgatacgaagtcaagtacagcagcttatctccctcccaatgtggatgggcttacagctggcacgattggaattagaattaaaaaagacacctaagctaagaaaattctggaacttgattaaaaagaatgatgaaaagatggatccagaagcaagagaacaggcatatcaagagaggagatttctttcacaactcatccagaagtttatctctgtgctgaaatcagtcccactttctgaacctgtcactatggacaaagttcattactgtgaaagattcattgaacttatgattgatctagaggccctgctacccacaaggcgctggtttaataccatcctggatgattcccaccttctggttcactgttacctttccaatcttgttcgtagagaagaggatggccatcttttttcccagcttttggacatgcttaaattctatactggttttgaaattaatgaccaaactggaaatgctctgacagagaatgagatgaccacaattcactatgatagaattacttctctacagagagctgcttttgcacattttcctgaactctatgattttgccctctcaaatgtggcagaagtagatactcgggagtccttggtcaagttttttggacctcttagttcaaacacactccaccaggtggcatcatacctctgcttgttgccaactcttcctaaaaatgaagacacaacttttgataaagaatttcttctagaattgctggtatctcgtcatgaacgtcgaatttctcagattcagcagttgaaccagatgcctttgtatccaactgagaaaattatatgggatgaaaatattgtcccaactgagtactattctggagaaggttgtcttgctcttcccaaattgaatttgcagtttttgactcttcatgactacctgctaaggaactttaacctcttccgcttagaatcaacttatgaaattcgtcaggacattgaagatagtgtcagcagaatgaagccatggcaatctgaatatggcggtgtagtgtttggtggttgggcgcgaatggcccagcccattgtggctttcactgtcgttgaagtggccaaacccaacataggtgaaaactggccaacccgagttcgtgcagatgttaccataaatctcaatgtcagagatcacatcaaagatgaatgggaaggtcttcgtaagcatgatgtatgctttttaattaccgtacgtcccacaaaaccttatggcactaagtttgaccggaggagaccttttattgagcaggttggcctggtttatgtcagaggctgtgaaattcagggcatgctggatgataaaggacgtgtcattgaagatggacctgaacccagacccaatcttagaggagaatcaaggacatttagagtgtttttggatccaaaccagtatcaacaagatatgaccaatactatacaaaatggagcagaggatgtgtatgaaacttttaatataataatgaggagaaaaccaaaggaaaataactttaaggctgtgctggagactattcggaacctgatgaatactgattgtgtggtacctgactggctgcacgatatcattttaggttatggggacccaagtagtgcacattattcgaaaatgcccaatcagattgccacccttgatttcaatgatacatttctctccattgagcatttaaaagccagcttccctggtcataatgttaaagtaactgtagaagaccctgctctacaaataccccctttcaggataacttttccagtaagaagtggaaaagggaagaaaaggaaagatgcggatgtggaagatgaagacaccgaggaagcaaaaaccttaattgttgagccccatgttattcctaataggggtccttatccttataatcaacccaaacgtaatacgattcagttcactcatacacagatagaagccatccgtgctggaatgcagcctgggctgactatggttgtgggcccacctggtacaggcaaaacagatgtggcagttcagatcatatccaacatctaccacaacttcccagaacagaggactctaattgttactcattccaatcaggccctaaaccagttgtttgagaaaatcatggcattagacattgatgagcgccacctactgcgtcttggtcatggagaagaagagctggagacagagaaagatttcagcaggtatggaagagttaattatgttctggctcgaagaatagaacttttagaagaagtcaaacgattgcaaaagagtctaggggttccaggagatgcctcatatacctgtgaaactgcaggctatttcttcttataccaggtaatgtctcgctgggaagagtatatcagcaaagtgaaaaataaaggtagtacattgccagatgttacggaagtctccactttcttccctttccatgaatactttgcaaatgctcctcaacccatttttaaaggaagatcttatgaagaagacatggaaattgctgaaggatgtttcaggcatattaagaaaatctttacgcagcttgaggaattcagagcctctgaattgcttcgaagtggactggacagatctaaataccttttagtgaaagaagccaaaattattgctatgacctgtactcatgctgccttaaaacgacatgacttggtcaagctaggtttcaagtatgacaacattttgatggaagaggctgctcagattctggagatagaaacttttatccctcttcttctacagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcagtattctaacaacatataatggccaaaagcatcttattcgcgacatcatcaatagacgatgtggaaacaatccattgattggaagaccaaacaaggtgacaactgttgatagatttcaaggtcaacagaatgactatattcttctttctctggtacgaaccagggcagtgggccatctgagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacaactaccacctgctatggtagaagagggtgaggaagttcaaaatcaagaaacagaattggaaacagaagaagaggccatgactgttcaagctgacatcatacccagtccaacagacaccagctgccgtcaagaaactccagcctttcaaactgacaccacccccagtgagacaggagccacttccactccagaagccatccctgctttatctgagaccacccctactgtggtaggagctgtatctgcaccggcagaagctaacacacctcaggatgccacatctgccccagaagagaccaagtagccaaactgtagtccttctaaaggaggacatggcagtcaaaaagtctgagtaaagctgttttttgtattttatatttgcttctgccattttactgtcactaattaatgtttagttcttatatttgttaactgatttcggtgtcttgaatatatttttttaaattatgtgtatgaacaattctagtttcatttgttcaatcagaagagcaaataaccattcctttcatgttttgatcactgagtgtgtctgtaatcatacctacattaaaatcattttctatgaatatataatatatacttcacatttttagtgaacttctctaaagaagaggacagaatatactggacttaaccacgaatacccttgagtgtccaaattgggaaggaacttgtttcttctgttatactatcaaatgcttaaattctgtttccttttttcttacctttgtttgctgtctttatgtaaagatattattagcagtaagatacaggtttcttcaatctatcaaagtggttacatgcatttccttctctcaaatcttagaatgccttagaatcacctaagatgtctgtttattcttgaggcacacctcagactgaatgagtcagaatctcaggattagagcctaggaatctatattttaggaggttctccacaccactaatgtttgggttgctggcagagtggcatcagccaaggctggttaggctgagccaggatttgtcatcagctaaataggaggactctgccaaatcaatctgggcaagaagcaggatcctgagtctgggcaatgagagtcagagaacttaactcctgtgtgcagggtagaattttcccatggcagaaattctgagttttctgccttatttttcttgggataaccagccacagggagaccttcaggtaaaatgtggttcaaatatgggaaggcagaggtacctgggaccttgctactcaagtatgatttgtgaaccaacagcatcaacatcgtattgaagtttgttatttatagaaatgcagaagtttgggctctgctccaaacctattaaatctaaatctacattgcaacaaagtccccaggtgattcacaggcactttgtagtttgagaagcactgtactaagattactgtgttgtcttcacatgaatgaggctataatgtagaattaccagtgaatgtgactaatgttttctgacaagggacctctgcttacaaggtccctgggcatggtgcccagaactgg

SEQ ID NO: 27 - DNA, 5042 bp, Homo sapiens
agccgagactgaaaaggagaaacaagactggattgaagctgtgcagcaatcaatagcagaaactctctctgattatgaagtagctgagaagatttggttcaatgaatccaacaggagctgtgcagattgtaaagccccagatcctgactgggcatccatcaatctctgtgttgtcatctgtaagaagtgtgcaggacagcatagatctttaggaccaaaagattccaaggttagaagtctaaaaatggatgctagcatttggagcaatgaactcatcgagctttttattgtcattggaaacaaaagagcaaatgacttttgggctggtaatcttcaaaaggatgaagaattacatatggactcaccagtagaaaagagaaaaaactttattactcagaaatataaagaaggaaaattcagaaaaactcttttggcatctctcaccaaagaagaattaaataaggctctatgtgctgctgtagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcagatttccctcaacatgatattcattccgagggtgtattaagtcaagagtcttcccagtccacattcctctgtgactttttatatcaagctccttctgctgcttctaaactctcttcagagaaaaaactgcttgaagagacaaataaaaaatggtgtgttttggaaggaggcttcttgagttactatgaaaatgataagtctaccacacctaatggcaccattaatatcaatgaagttatctgcctggctatacacaaagaggacttctatttaaatactgggcccatctttatctttgagatctacttaccctccgaacgtgtgtttttatttggagctgaaacatctcaagctcaaagaaaatggacagaggcaatagccaagcattttgttcccttatttgctgaaaacttaacagaagctgactatgatttgattggtcaactcttctacaaagactgccatgccctggatcagtggagaaaaggctggtttgctatggacaaatccagcttgcatttttgccttcaaatgcaagaagttcagggagatagaatgcacttaagaagactgcaagagctaacaatcagcacaatggttcaaaatggggaaaaactggatgttttactcttggtagaaaaagggagaacattatacatccatgggcataccaagttggatttcacagtctggcatactgcaattgaaaaagcagcaggtacagatggtaatgctttacaagatcagcagctcagcaaaaatgacgttcccattatagtgaacagctgtatagcatttgttacacagtatggtttaggatgcaaatatatctatcaaaagaatggtgatcctttgcatataagtgaactcctggagagtttcaaaaaggatgcaagaagctttaaattgagggctggaaaacatcagcttgaagatgtgacggctgtgttgaaaagttttctctctgacattgatgatgcactgcttactaaggagctctacccatattggatctctgctttagatacgcaagatgacaaggaaagaattaaaaaatatggagcatttatacgttctcttccaggggtcaaccgagcaacactagcagctatcattgaacacctgtatagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgaggttaaagaagatcaagtcaaacaaatggacatagaaaatagctttattaccaagtggaaagacacccaagtttcccaggctggagatttgttaattgaagtatatgtagaaaggaaggaacccgactgtagtattataattcggatatctcctgtgatggaagcagaagaattaactaatgatatattagcgataaaaaatattattcctacaaaaggtgatatttgggccacatttgaagtcattgaaaatgaagagctagagcgtcctcttcactacaaggaaaatgtactggagcaggtgcttcggtggagttcattagctgaacctggctctgcttacctggtggtgaagagattcttaaccgctgacacaattaaacactgcagtgaccggagtacactgggaagcatcaaagaaggaatcttgaaaatcaaagaagaaccatccaaaatactatctggaaataagtttcaagaccggtattttgttttacgagatgggtttctctttctttacaaggatgtgaagagtagtaaacatgacaagatgttttctctcagttccatgaagttttatcgtggagtgaaaaagaaaatgaagcctccaacaagctggggattgaccgcatattctgagaaacatcactggcacctgtgttgtgatagttcacaaactcagacggagtggatgaccagtatctttattgcccagcatgaatatgatatatggccaccagctggaaaggaacgaaaacgttcaataaccaaaaatcccaaaattggaggtttgcctctgattcctatacagcatgaggggaatgcaaccttggcccggaaaaatattgagagtgcaagagcagaacttgaaaggctgcggctcagtgaaaagtgtgataaagagtccgtggactctagcttaaaggagagagcttccatggtggcccactgcctggagcacaaggacgataaacttcgaaatcgaccccgaaaacatcggagtttcaactgcctggaggacacagagcctgaagccccacttgggcaaccaaaaggccataaaggcctaaagacattgaggaagactgaggacaggaatagcaaagctactttggactctgatcataagttaccatcaagggtaattgaagaacttaatgtggttctacaacggtcaagaacccttccaaaagaattacaggatgagcagattttgaagtaggaaataaaatgaattgctccccagattatttttttaatattgtatgcaatctttatgtgtaactccaaaactgaactataagataattcataagaatttgcctattgataggcaaatttgtctatgcttaggcatttaaggagcatttaaaaatatgtatatatgtgactgaatgtaagattaactttattttggtctgaacaaaccttgtaaagttccattgtattaacgtgtgtaagaagacattgggttacttaggtggtcagtccttttaaagtagttgtctgttaagtggtataatttatgagcagaaatctcaaactgtactgtattgtataaaatgctgtgtttaaatgaagcctaagaaactatctgtaacatattttgcactttgagaaaccttgtatattaaattaccatatgtttttaggtttacagaagttctaccttagggaaaagaaagggaagtaaattgaaaaaggggggagaatttattgtagtggctgcctaaaaaccactggagtttttaaaagaagcaaggagttaaatgtcctgcaaaacaaggaagtgagctaagattcattctagttcactaatgaccagaacttgtcaatgagaaaccacttgttaagaaaaagtccagtgtttatttctcaagagtaatattcggccaacagatgtaaataatagcactagccactcttattaatatttatagtgttagaaaaccagccacattacagattcactacgtttgagctcattgttggtggctgctaagaggaaacttacactgcattggagaggttgtgtacacaggacctggcctggatgctgattgcactgtcattgtatgcaagcattttgtcttttttcagaatttctgactatacttttggtacgaacaaaattcatcaccacagggtcctgttgttttgtttgatttttagatttttttaaattattattaaggttgtaatgtttttctccgagttgtcagaaataactggaagaatacaatatatggccattatggagccaggggctagttggtggtttactatacatttgggggctacctggtcacatttaatctaggtttttttttctttttttaagtaaaggtgtggtctcttccctgtacttatgaataaggacaaagccctatttttgtttccacataaagatcagctactgaattggtgaatttcctgacagacaatgctatctaaccatagttcacgttaggggaagcatttttccatcagtttctttaaaattggattgtctggtgagttttgatattaaacattatgtagctaagtttttttttttagcatttcttttttatttttcaatctatattcacaggcccatacttcagtcagtccaatcatagtacagtgatgtggtggtagatgctatgaatttcttcattgtaaaatacggatcatttgtattttggggtgataaaatagttcaccatgggtatgagatatttattctttaaatcaaagtaaattagaatttttaaaaagcacaaaactgcaggacagtttatgaaataggtggcactattagggaatcttcctttaaagcaagaaatcatgttatttagaaagaaaaactaatcttaaacatactatttctaataaatatttatatttttatgaaataaagaggtatgtggaaattaatatttggtgatgttggacagtggaaaagtatctagagtttttacctgccttatctgaattcttcttgaaacttgagcttaaactctaatagctgtttccctttctattctgaacaactgtctccatttttcaagtgtgagagataagggctaatgatgacatctcatttattttgagtaaacattaaaattgttttacaagtctacttg

SEQ ID NO: 28 - DNA, 3311 bp, Homo sapiens
cgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacacacacactcttgatcccttgcttccctcccccagtgcgttctgtgatcgccaagttcaaagctgtgcacatgtggacactcaataaatgttcattggtg

SEQ ID NO: 29 - DNA, 4591 bp, Homo sapiens
ggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcggcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccggacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccaaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 30 - DNA, 3767 bp, Homo sapiens
gctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacagggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtccggctgcagggaaggggcaagaaggcgggcaggccttcactgcagcactgagcctcaaatccgctctggagcatgaggctggatgcagtggtggtgaggccgccccgctccatcccgaggcagccaggctttgttttgcgctctcctgtcacaaatgctgcactattggttcttaagttttttatctccagatcctaatttatgcctatgcaaaaaataaatgacgcccaagagctg

SEQ ID NO: 31 - DNA, 5449 bp, Homo sapiens
atttttttctcctcctttttttaccctcccgtttttttcttttcttttttttttccctatcctttttttgtgaatgaaaaaaggaggtcgcgagcggtacctgggactgcagcgccaggcgtcttcgcggcagcgccttcgccgcgggcccgggcgcgtagcggcggcggcctcgcccctctcccggcgcccctgcgcgccgcccgctgcctccgcagcccggctccgcgcgccgccgtgacattgggcgcctggcgcgcggggcgatgctgatccggaaggggcagcggctgcagtgcagcgcgcgcgtccgctcctgggcccacgtccggcctgggctgccctgccggagtttctgagtggccgcgagctggccgggaggctggagcccagcagcagcgcggcggcgccggcgtcgtcccaacttgcaggcgcggagggacccctgacatttcactaaaatgagcgtgctcagcaggaagagatgtgttcctcacgctagaagccaccccgtcacatgtagtggtgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagtgccccgcccacctcctggaggacccgctctgcgcggacgtcatcctggtgctgcaggagcgggtgcgcatctttgcccacaagatctacctctccacctcctcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctggcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagtaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagcgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacac

SEQ ID NO: 32 - DNA, 3911 bp, Homo sapiens
aacttacatgcttgctgtaactttggatgaatggaaaaagaaactggaatctcccaacagagaaattattattttacacaatccaaagcttatggtgcattaccagccagttgcagggtctgatgattggggttcaacacccatggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaagggttcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaaaatg

SEQ ID NO: 33 - DNA, 4086 bp, Homo sapiens
atttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatac

SEQ ID NO: 34 - DNA, 3999 bp, Homo sapiens
caagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatg

SEQ ID NO: 35 - DNA, 5252 bp, Homo sapiens
cacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacacgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggagatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaaggggggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggagaaccaaactgtcttgctaactgccccctggggactctagccctgcctgcctcacgctgaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaacgtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttatgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggc

SEQ ID NO: 36 - DNA, 4628 bp, Homo sapiens
gagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagcatgctatactgaactcaacaagatcttggctgtacataaatatttgtaaaagagaccctttgcacctttttactgtcatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaat

SEQ ID NO: 37 - DNA, 4186 bp, Homo sapiens
gaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccatgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactc

SEQ ID NO: 38 - DNA, 3882 bp, Homo sapiens
ggagaactccaccgggctatgcgaacagaatcctgcgaagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggtgagcactcttggggagagagtggttctgtatgttctgaatcgaattatttatagaaaacaggaaatggagagaaatgagatcccattcctgtgtcatagcagtactgattatgctaagattctgtggaagaaaggagaggccattgggttttattcagttaagcctacaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatacagcttgcaagcaatactttgagaagtatccaggagaccatgaactcctttgggaagttgaaggtgttggacactggtaccagcgaataccagtcaccagagcattacaaagagaagcacttaaaattctagcactttctcaaaatgaacctaaaagacctatgtctggagaatatggtcctgcatctgttccagaatacgaagcaagaactgaagacaatcagtctagtgagatgcagctaactattgattctctaaaagatgcctttgcaagcacttccgaaggtcatgataaaacatctgtttccactcatactcgaagtggtaatctaaagcggccaaagattggaaagcggtttcaggattctgaatttagcagttctcaaggtgaagatgaaaagacctcccagacttcacttacagcttcaataaacaaattggagtctactgcacgcccatcagagagctcagaagaattcctggaagaagaacctgaacagagagggattgaatttgaggatgaaagcagtgatagagatgcacggccagcactggaaacccagccacagcaagagaagcaagatggtgaaaaggaatctgaattagagcctatgaatggtgagataatggacgattctcttaagacctcacttataacagaagaggaagactccactagtgaagttttagatgaagaattaaaattgcagccttttaattccagtgaagactctacaaatcttgttccactggtggtagaatcttcaaaaccccctgaggtagatgcaccagataagaccccacgtatacctgactcagaaatgttgatggatgaaggcacatctgatgaaaaggggcacatggaagagaaattgtccctacttccaagaaagaaagcacatcttgggagttcagacaatgttgctactatgtcaaatgaagaacgatctgatggtggttttccaaactctgtgatagctgaattttccgaagaaccggtctctgagaatttgtctcctaatactacttcctcattggaagaccagggtgaggagggggtatctgagccccaggaaacatctactgctcttcctcagagttctttgatagaggttgaacttgaagacgtgccattttcacagaatgcaggacagaagaatcagtcagaggagcagtctgaagcatcttccgagcaactggatcagtttacacaatcggcagaaaaagctgtggatagcagctcagaggaaatagaagtggaagtgcctgtggtagacaggcggaatttaagaagaaaggccaaagggcataaaggacctgctaagaagaaagctaagctgacctgaaggaagaagaaagtggatgataaatcctcttctttgtaacatagttgttgtttttaaaatatggtaattaataaacagcatggggcacaggacaaaaatttccaaaatttcaatttgaacttacttactatgcagttttttgcttccctttagaacgtagaattcaccattgtttttaattttccaggctatttttggtaaatgcaattttttatttttattaaccatgtttcaattttgggaaaccagatcatattatattttctttatcaggtggtacatctgaccattatttcaaaaatataattaaaaagctgtgaaagtagtaggatttccattacttataaggatcacagaaatcttttatactaagggttttaatagtaaaacttggtgagggttctagaagttttaaatttcaaaactaatcaccaattttttaaaatgtaggcatgcctaaacaaaaataagtgtcaataaattagaaaaaatataacttcaagtaaatgagagcacaaaaacagaaacttacggtcaaaggttcatgaagatattttggttttggcctcttaatcctagatatagatgcagttttttcctttgacttcactatctatggaaaggtacacataaaatctgtttctgattcattctatcatctgatgttaacagtactgtcagggatttaactgtggcatgtggggactaattatttaaaatttcatttgaagtattagtttgctgtaattttttttgtctgcatatgtgcagacgcctagaagtttagactttcacctttaatcaggtaaaaatcacaactatactttggagacatggtttaatttggacttctggtcctgatcagatagataaattaagctggagattttacttttatcccaacccagttaacatctatatttcagaagtatgaggctccttcctaaggcatctccttaaatcttgccacctccctaattctacagtcttatttatattcccccacagctttcatctacttctgtaactcatggagtgattctccaatcaacagatcttcctgcctgccggcttatgcccttgatgtccatttttgggtaggtttggaggtgcaccccacaatgttagacctatatggcaggagtaaaactgcccccagtgttagacctatatggcaggggtaaactgcctttgggggagctgtggttacaagggcttcaatcatattggaggcttcaatcatcctttgatttgtactgagtactggttgcaagctggcctgttaagtatatattgtgttgccataacaaaggcctaggaaaatttgaagaaaaaaaacactgaactgttattttttgtaatttatttaaaaatggacaaaatggttattagaatccaaagataatctaaaaacagttctactctttggaaatattatgtgtactcaaatttgcacttaagttggagaatgttttgagaccatttaaattgttttaaaaatagcttgatcttgatccttatgcaaaagaaactaagactttgtgtcattatttgaggtagctaaggactgatgttgaaagtgtattcagtctatagtaagctgatgtcaggtcagtaaattttgtttggggatgttggtattttcgatcaagttaaaatcttaaagcagacaaaaatagtaaacgctcctatttgtgttagattttgaacaattgtattaccctatattttctttaattagtcaaaggtaagccagattatttcattctaaatgaaaattaaagcactttggccatttattttttcaacaaatgctaatactaagt

SEQ ID NO: 39 - DNA, 3875 bp, Homo sapiens
catttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcttttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttacctt

SEQ ID NO: 40 - DNA, 2505 bp, Homo sapiens
ccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatg

SEQ ID NO: 41 - DNA, 5892 bp, Homo sapiens
attctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccactcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgtt

SEQ ID NO: 42 - DNA, 6189 bp, Homo sapiens
ggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctcccccagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcgtgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacagcatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacagggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctgtatgaagtgggcgaggacccagtcctgtctcagccagtaacagtgaatctggaggtgaacttccccacccccatccagaccataagccagggaagcaaaccctagatgaagccccaagaaactgccttggcaaagagatccacgagggcttcctcccaaatggacgctggtatgggccccaccccgcccttcttcatggtcttctgggtttgtcaggtattacaactggcctggttttttagggttttttgtgtatatgtgagacaggatctcactctgttgcccagtctggggtgcagtggcacaatctcagctcactgcaacctctgcctccctggctcaagtgatcctcccacctcaacctcccaagtaactgggatcacaggggcgcgccaccacgatggctaagtttttttttttttttttttgagaccgagtttcgctctcgtcccccaggctggagtgcaatggtgcgctctcagctggctgcaacctccatctcccaggttcaagtgattctcctgcctcagcctcccgagtagctgggattacaggcatgtgccaccacgcccggctaatttttttgtacttttagtagagacagggtttctccatgttggtcaggctggtcacgaacccctgacttcaggtgatccacctgcctcggcctcgcaaagtgctgggattacaggcgtgagccaccaagcctggcctagtttttttatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaacaaaacagattccccatagagttgctttgaaaggtgacttagagtcagacaatccagggtccacacccaggcccctctacgggggcatctccggcaccccatgcctctgggcctcagtttccccccatgtaaaatggggagaggtgagagttctttgcccagaaggttgctgagaggccctggcactaaggggcctcgtgcagtgtcagggcccccaggcctcgtccccttccaggttcccctcttggctgatgttgccctctcagctctactatcaggcgaggcttccgccacctggcctgcccacgctccctccccagaaggcatgacctgagccgcctcatttctttcccagtttgcattctttctatttcatttcctgctcatggagaatttctgtgaatctctgtgtttctgccttgggcctccttcgacatctgagtcttcaggggaatccagagaagccccagtaccttttcgccatgatgtcttactgggccacccacctcctctttcatgatcctcgccagggaggatcctttcctcacggtccctggcctgcctgagagcaggtctaggccatggcgggtaccagtgcccagcacagggccagcctgccctgggaagcaaggaggccggcgtgggacctggaagttggtcatctgatgctcccccgtttcacagatggaagcaccaaggccctgagacaaggagacggttgggatggacaccatgactccctgcccaacgtggacggtggtggggtggaaagaccattgagttaggaacgcagtgagtttggctgcaagtcacaaaacacctaacagatgtgcttagaacagaggacagagtgttttctcaccgaacaggcatgtccgatggaccccaagcgctgtcaccgtgggcccgatcactgtcgtcttcccgccatcgccggcagactggcttttgtcttttgccgtctgcttgtttgcggtcacaagatggcacaggcctccctcatgagcaaatttcaaggcagggtggggctcggcagtagtggccagaaaggccttgccctagcgtggctctctccctccgtcagcacacagaagcttctccaagagccacccccacccctcctgctccacagacttttccagacccctaagggcctcctgcctcccctaggtgtaagggaggctgggacaaggcctattgggaaagggggatggggtaactgtggctggcttcctccctggactgggcacggggccacctgagcaatgtggggagaggagaactccgcggtggggtgggcagctcaaaatgccacacctcccgggctgctcctccagctcggccacctggtaaagcatgcacctcccgcttcagtgtcctcatctgtaaagtacacggccagtcctgtcctcgcagatgtgctgtgagaagcagatgagggagctgtgtcaggcaccaggggaggacctgggctcctgaggacaccgagttcgtggtgtgtctgccctgctgctgtcttggttctctgctcagctctggaacttggtgcagctcactctccctctgctcctctccctgcaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccgtccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagaacacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatg

SEQ ID NO: 43 - DNA, 4715 bp, Homo sapiens
gaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatggtggtgtttgggctacagtacagtttctttcaaaatcctttttcgatcattcaatgcatagtgcattgccccttgggatatatttggcaaccaaattctggatgtatgtgacgtggttcttctggttttggaatgatctcaactttttatttatccatcttccattccttgccaatagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctaagtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagttttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactctt

SEQ ID NO: 44 - DNA, 5542 bp, Homo sapiens
ctgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgtaaccagtaatcacaaggaaagtgtcccctttgcatatttctttaaaattctttctttggaaagtatgatgttgataattaacttacccttatctgccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccagacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcaggagtcaaggccactagaaaattgacagttaagagccaaaagtttttaaaatatgctactctgaaaaatctcgtgaaggctgtaggaaaagggagaatcttccatgttggtgtttttcctgtaaagatcagtttggggtatgatataagcaggtattaataaaaataacacaccaaagagttacgtaaaacatgttttattaattttggtccccacgtacagacattttatttctattttgaaatgagttatctattttcataaaagtaaaacactattaaagtgctgttttatgtgaaataacttgaatgttgttcctataaaaaatagatcataactcatgatatgtttgtaatcatggtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaataaaaactttcctatat

SEQ ID NO: 45 - DNA, 4343 bp, Homo sapiens
cgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaaggcatcctggacctggggccccgagggccagggggccatcctgctggtgaactgtgaccgagagacaccctggttgcccaaggaggactgccgtgatgagaaggtctacagcaaggaagatctcaaggacatgtcccagatgatcctgcggaccaaaggccccgaccgcctccccgccggatacgagatagttctgtacatttccatgtcagactcagacaaagtgggcgtgttctacgtggagaacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggacattcccctgactcccatcttcacggacaccgtgatattccggattgctccgtggatcatgacccccaacatcctgcctcccgtgtcggtgtttgtgtgctgcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtctggtggtcggaggatgaccaaggtggtgcgtgacttcctgaaggcccagcaggtgcaggcacccgtggagctctactcagactggctgactgtgggccacgtggatgagttcatgtcctttgtccccatccccggcacaaagaaattcctgctactcatggccagcacctcggcctgctacaagctcttccgagagaagcagaaggacggccatggagaggccatcatgttcaaaggcttgggtgggatgagcagcaagcgaatcaccatcaacaagattctgtccaacgagagccttgtgcaggagaacctgtacttccagcgctgcctagactggaaccgtgacatcctcaagaaggagctgggactgacagagcaggacatcattgacctgcccgctctgttcaagatggacgaggaccaccgtgccagagccttcttcccaaacatggtgaacatgatcgtgctggacaaggacctgggcatccccaagccattcgggccacaggttgaggaggaatgctgcctggagatgcacgtgcgtggcctcctggagcccctgggcctcgaatgcaccttcatcgacgacatttctgcctaccacaaatttctgggggaagtccactgtggcaccaacgtccgcaggaagcccttcaccttcaagtggtggcacatggtgccctgacctgccaggggccctggcgtttgcctccttcgcttagttctccagaccctccctcacacgcccagagccttctgctgacatggactggacagccccgctgggagacctttgggacgtggggtggaatttggggtatctgtgccttgccctccctgagaggggcctcagtgtcctctgaagccatccccagtgagcctcgactctgtccctgctgaaaatagctgggccagtgtctctgtagccctgacataaggaacagaacacaacaaaacacagcaaaccatgtgcccaaactgctccccaaagaattttgagtctctaatctgacactgaatgaggggagaagggaaggagattctgggattgccagttcttccagcagccatgctctgaaaatcaaggtagaatccatggaaagggaccccaggaccccgggaccctagacgtatcttgaactgccatcgtcatttcaaatacatctccctcagggtttccaggtggccacccccaattattcattccttaccaacctctcaaatcctcttggctttctctctgcagtgtggacactgttggctagtcctccccactccctgagggtccagtaagttagcttagaaccttcctggaaacatttcatctgagcaggtttccccacgtgtgggatgctccttttgcctcatctgtctcagggatgcaggctcccccgcatgcatggggatttctccccagaccagcatacttgtgacctgagagttcaatgcgtaaagatgcccctggtcagccatatccatcttctcttgcctggtccttgattctctggccgctccctgaccttcctccttccactgccttgactttcttcctttttattcctggtgccatctgtccaggcagctagacaagaacttgttcgccagcagccagattcaggccttcccaggggcataataagtgaccagcccctcctctccggacatcagatccaacacataaggaccctggcctaccctccagcccaacagccagttctgggtcagctgccaacttaggggtggtttgattatcccattgaaattcaccagtgcctttgccaaagaccctctcatttggacatacccagattcattccctggctccaactgaaaagactcagtttcaatcgttaaaagttcctttagggccagaagaataaatgaattataatcccattttgaagaaccgatttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagcccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgtttggttaatgtgggtttatgggttttctttctttttttttttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtc

SEQ ID NO: 46 - DNA, 3403 bp, Homo sapiens
caggtctgaggcgaagctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaagcggggcagggtgcgaacaggggcttcgggccacgcttctcttggcgacaggattttgctgtgaagtccgtccgggaaacggaggaaaaaaagagttgcgggaggctgtctgctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaacaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacagttctttccttactggtgctgataacaacagggaaccgtgcagtgtgcattttaagacc

SEQ ID NO: 47 - DNA, 5285 bp, Homo sapiens
ggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 48 - DNA, 5223 bp, Homo sapiens
gcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgcggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccaccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtctttttttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctg

SEQ ID NO: 49 - DNA, 4692 bp, Homo sapiens
gcgcggcccggctggccgtctgcgcaccctctctcccctcggctctttcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattctcagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaacttt

SEQ ID NO: 50 - DNA, 4341 bp, Homo sapiens
cgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttacgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagccgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctgtcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaat

SEQ ID NO: 51 - DNA, 2576 bp, Homo sapiens
aattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgtttt

SEQ ID NO: 52 - DNA, 4147 bp, Homo sapiens
ggagtgtagaggaaataaaatcatgtctgtggctcatgacagcattccatattcagttgttgggttgtgttgttgttgttgtgtgtgtttttaataataccatgtaactgtttaaaaaaatttcctttttgatcaagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgattt

SEQ ID NO: 53 - DNA, 4350 bp, Homo sapiens
tctttccagcatgcctccggcttcttgggggaacacagtcccggtggtcagaggtcctgcaggggaggcctctctctggaacgcctacccaactccatcgcctcccgcttccgcctgacagagagggaggaggaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaagtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatcttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggggtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggcctctggggtctgaccaggggtactgagcaccggccctaacacttccatctccacccaccccatctccctggcgatgtgctccagcccaagcagcctccgtaggctttagatcctgtggttgctagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttctccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccagctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcatttac

SEQ ID NO: 54 - DNA, 4946 bp, Homo sapiens
cagcctcagcccccagatgaagatggggatcacagtgacaaagaagatgaacagcctcaagtggtggttttaaaaaagggagacctgtcagttgaagaagtcatgaaaattaaagcagaaataaaggctgccaaagcagatgaagaaccaactccagccgatggaagaatcatatatcgaaaaccagtcaagcatccctcagatgaaaaatattcaggtttaacagcaagctcaaaaaagaagaagccaaatgaagatgaagtaaatcaggactcggtcaaaaagaactcacaaaaacaaattaaaaatagtagcctcctttcttttgacaacgaagatgaaaatgagtaagtgtaaatattttgaatttagtctactttgaaagtatatggagtgttcattaaaatcacattttttcctattataaagatactacaagttctttatagaaagtttaggaaatagagaaaaaaatttaataaactacatctattcatcaatacccctctgacttaaaatgccaactctatagaaattagctagtattaacattttgttatttcccttgtgtggttgtatatatatgtaaattatatttttaagcaaaatacattttttgtgtgtaaacaaaattttataaatacaactgtattgcaaatgttctttgtcctgcttctcacttgacattgcattatgagtattcttccaggtcagtaaatttcaaaaacctgacattaatagctacagataatttcataaacatctcattgtatctttttcattagcaatagctccactttgggtgggggagatgataatgtgccttgttaaaaatacctccccaactcctgctaagggtggccatgagactcagctctggcaagttaagaaatacaggtggaattctgcttgataaagctgctgggttttttgttacaaaaggacagacttggcaaacatgagcctttgctcttatcttttcatcctacttggagtgcagagataaaacctgagtaccagagccacttttaggcataaggaaggcagccatgtgctttgggtcatgttagtaaaaagactcagagcttggctccttgctgacatgcctggaggagctgctacaccagcttggattgctgacctctgacttcttggtagtgagaagaataaacactgtgcttaattaggccttggtcaggtttcttttatatgcagccaaatgcagtcctaagtaatacaataaataactggtcaaactgttactggtggagggtgtccaggttcttggcattttggacaaataattgaacaaaacgcacaaagcaatgaatatcctctagaggtttgccattggttacttggcgtacaccctgtgtaaatgaagtagtggcccgtgacctgtctgattggtgcagaaagtgaccaatcagaggctgaagtgaagttacaaagttatactcctgtgtaaatgaggacttggcctatgaccagtctgattggttgcaggaggggaccaatcagaggcactttcatttttcatctgcaatgcagaaaaggcaaggggattgcaaagggagtagcctctgatccttttgttacttaggtatggagaggtggggttttccttttgattcagttctaggaagtcaatgtgaatcagccttaggttccctgtctccagaccctattctcctgcctcattttccccctgagagacgtgatcctcgtaaatctttatgggaggctgagagactgagggtctttcttctgtaactgcttcatgctaacttgggacacagtccctacctattggagatcacgtaactctcaccctgctttgtctaggggagacagggtagcttcttgatggccggtggtgtcttctcctgaaactggctagaaatcttgtcacatgatcatctaacttggtggtctctaggcaaaaggaaatggatttggttaaaagatttaacagatatggtccaaaaaccaaggcaaatataatcattaataatgggctggccaagggagggagccatgaaacccaacttagtgccctttaggtgccccagctgttgtcatattttagaggcccagtcagctagttttcaggtggtgtcccttactaatcctgattggttgacatcaaaacagcattcttcttctaggaaaatacataagccacctgtttcagcagttaggagatctagtccccttcgattttgcaaagcgaccactgccaaggagcctatccgaatttgtaaggtgacaatactttgagcaatgttatccaggctttccataaaatccttggacaagcgttggtaataggatagggaagttgcaatcccgctaactcccattcctacctctgctgttattcctagccgttgtgtctggtggttgcagttaaaggtataatgagggattggttgttgggagctatattaatttagggacatacaatatttctgtctccagtctaccacttccaccaaagacaaatcacagcagaaccgacctaacttcaaaataaactgcagtcccatatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttctgtctaatccaatggcacactctccaaagttaccagaaacctgcattcaagagttcttttcatgaactccaaagaagtaagccttggactgtagctgattataagtcactttttttttttgagaaggatcaaagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacagtggctcatgcttgtggtcccagcactttgggaagccaaggtgggagaattgcttgaagccaggaatctgagcccagcctgggcgacaaagcaatacccctatctctacaaaaaataaaaaatagccaggtgtggcgacacacacctgtggtcccagctgctcgggaggctgagcgggaggatggcttgggcccaggggttcaacgctgcagtgagctgtgattgcgccactgcactccagcctgggcaacagagtaagaactgtctcaaaaaaaataaaaaatagaaataaattttaaaaaaagaattacccatattctctttgtttttgtttattcacattaacctttattctatctggaatttatttgagtatacttttttctcaaataatcaattgtcctagaaccatgtgtttctcatttatttgaaaggccatctagtgagagatttctccaaatgttggggtagggaagggaggggaagcactttaaagtctgagcctttagaggtgattcctcaagaccctgcttaatcctaacaattttcctcattagtaaaagtcagcccaaactgggggcttgttaagatccttaccagccacatccatctgaaattatgaatttcaaagtatcttacaaatttggtgccacattatcttttttaagtttgttttgttttgtttttttgagacagagtctcgctctgtcacccgggctggagtgcagtggcgcgatctcagctcactgcaagctccgcctcctgggttcacaccattctcttgcctcggcctcccaagtatctgggactgcagtcgcccgccaccacgcccggctaatttttttgtatttttaatagagacggggtttcactttgttagccaggatggtctcaatctcctgacctcatgatccacctgcctcggcctcccaaagtgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatg

SEQ ID NO: 55 - DNA, 6496 bp, Homo sapiens
gtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccgcttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcttcttgcctctcaagggttgaggggtcctttctgtcaagtaatggttatttttcgtggtatcctgaggttcagggtgttttaagctgggggtaggtggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtatcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatg

SEQ ID NO: 56 - DNA, 6083 bp, Homo sapiens
cataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggcccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattatcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctatgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagt

SEQ ID NO: 57 - DNA, 5224 bp, Homo sapiens
ggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaatggttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaacctactgtaagtacccagggaggctaatttccttaaaaaaaaaaaatctatccatctacttctctcttacctgatttatgtgttagaataaattcatgaaattcgattccaagcatacgaaagatgcctaaagttgattctatgctccttagatccagacagaataatgagtacaggtttatgaaattctaaaagtttctgtcgtctttaaaaaggaacgtgcagtatatttctatctggctgtttagataaccctttccttgtattaattgtgagcacggagctcactggtgggggaggttctgaaactctctgccctcctgtggttgaatgaagatgttgcaagacttgcacaaaggaggttattcttctgacagcatcaacttttagagatggttctttttcatctttccaattcagttacttgacagtctccttccccagtatgctgaagtttgttaagagtcaccagtaattgtgcttttcagacagtagtgcagcttcaaaatcgaggccatcactgggctgatgggctgggagaaccttgccatgtgcctgcctgtttcctgcccccttagtcactgcccatttcctgcccccttggtcgctgacacaccttcacccaaagtgccatggttctgatggtggcagttccatctccctgacatcaggaagcttttctcgatcagagcagagcggggcctgcctgccctcgtgtcactggatttctttctcttataatcagctgaaacagagttctcaaagaacagtaaactcaggttcagaggtattatggaataagaatggtttcatagtttggcttttctatataattcctccctctcaaactgaaatattcatttttttagtggagtatttgactagagagaaggtaaggcagaaatacagtctacactggcttttaaaaatgtaaagccaatttccaaccggaccccaaatagtacaggttgaacattccgttccaacaatccaaaaccccaaatgctccaaaatcttaaactttgagttccagcattccgtcagaagtggaaaattttacacctgacctcatttgacaggtggcagttacagtgcaatcaaaactttgttccatgcccaagattattaaaaatattggataaaattaccttcaagctatgttgtataaggtgtatataaaacaaatgaattttgtgtttagacttgggtctactcccaagatacctcattatatatatacaaaaatccccaaatccaaaaacatttgaaacacttctggtcccacacattttggataagggatatttgacctatatctaattatataataagaaaaatgtattttctttttttttttttttttgagatggagtttcactcttgttgtcgcccaggctgcaatggcacaatcttggcttactacaacctccgcctccctagttcaagggattctcctgcctcagcctcccaggtagctgggattacaggcatgtgccaccatgcctggctaattttgtatttttagtagagacggggtttcgccatgttggtcagactggtcttgaactcctgacctcaggtgatccgcccgcctcagcctcccaacgtgctgggattacaggtgtgagccaccgtacctggcagaaaatgtactttctttctcagaaatacttttaaaaaaaattgaagggtgaggagaaaaacatcttggagaagaggacccattaaaactttaaatatctgtgggaaccatttttcctgattttcccttttttaacatcatggcaaagatgggtttttttccaacaaaatttaatttaatatctttccacttgaagattttaggtttgttttcaatacttaatgaatataaaactaaaggagaaaagccaacctgaaataatttaaactttatatgaacatttcgataagagtttgtggattttttctgtagataatatatttgatccagaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagtggaaaaaaaacaaaatttgactttttatggccaaaattccttgttgacagctgtgatgttctaatatgatttgggaatatgtcagtctacagaacctgcatcctgtaaaaacacctttggggtagacgataaaagtcatttttaaggcaaatacttaccatgtgactttttattaccaaatgcatcagtagtggagctggtatgttgtttcataggatggaaacattagaagtccagagaaaaataaattttaaaaaaaggtggaaaagttacggcaaacctgagatttcagcataaaatctttagtatgaagtgagagaaagaagagggaggctggttctgttgctcgtatcaataggttatctgtgtccctcatcttggtgttacagtgttatttctgtcagtattatgaatatgtggttgacccatcctgtcaaatgtaccaacattttcgaaagaattcattcaaatctcttatgccaacagaaaagttccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaagccctttgatcgcttcagcccgggacatgcccttcagatggcttattctcagtaaagctttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcatacaagtgttttcacaaaagccatttgcctaggcagcaaaaaatattaatttgtt

SEQ ID NO: 58 - DNA, 2432 bp, Homo sapiens
ggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggat

SEQ ID NO: 59 - DNA, 6447 bp, Homo sapiens
gaaaactcagactcaaagaattaaaggaaaacagaggaaaaatgcccagttaaaaaaaaaaaaatcatgtttctgttttttcctctagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggatctcactctgttgtccaagctggaatgcagtaatgcaaacatggctcactgtagcctcgacctcgtgggctcaagcaatcctcccacctcagcctcctgactagtggaaccacagacatgagctgctgcacccagctaaaatggagtatttttaatttctgggtcttttaaatgcatttggaggtctttagttttacctcactgaaattaggattttaattataaataatcaaagatgtgaaccttacagacattttaaagccattatattttttctataaaccctgttctcgtttggaggagaaagaaattggaattttcaaaaaaaataaaaatacctttaacacctatttagtgtctttagtaatccagtaaaatacttgattttttactaaatgtttcccacaagccaagcaaaccataagctacaataataattacctagcgtacagccctctttgcatatgctgttccctccacttgaagtgtactgtttaatttcttaaaataactttagcttttaagaaccaattttgatgggagtacagacttcccccattttcttgatgagttctctccgtcatgtgtagtaataatgtgagaatttgcagtttttagttgtagcctatacttttaggtctttgtgccaatttgaaagttattgggttagagtattcatagacattttcatggtacttaaagggacaggggtttagtaaaaagacacatggcaagccaggctttttccacagtttgccaggcccagctgcctcttgtgtacctgaacagattttatcattaacccttgtttatgttgttttgttttatttcgacgaaggcttattttaagtcaggcatggaaaactagacttcagactgacttcagctttaaggacatgtttatcccgttaacagggagtctgggatagacaatctccaggctttgtttttctctgaatttcttagctctgcttgtgatggcttcatcatcaggccacagaccattaacacattctagaactttaacattggttaaataataccatctaatagcctgtcttcagcatttccccagttgcctccaaatgcccttcatagctgttctctgcctctgtttgtttttaatccaagatacactcaaggctcatatattaggttgacatagctctttagtatcctttaatttaaagcagtctccaggtttagagaaagatgaatgagctttcacatacccctcacttgtcttcttcagaagtgtaggctacaactaaaacttccttcttcagaaggaagacaagtgatttatatttatttacttccatttctatttgaccttgtttcatctaaacacacccactccaccactgctacctgattaatattaagtgaatctcaaacattgtatcattttagctccacgttttttgtatgtatctccaaaatataaagattcttaaaaatataaccacaataccattatcaccctaaaaaaatcaataatgattccttaatatgaccaactactttgtcaatgtacacctttcactcctcttaactttcataaagacttatgtgtttttttggtttttaagtttgttggtttgaagttaaatctatgggttttccctccatctctctttttttaaccgtataattttttgcatgtgtatatgaataaatctgattatagattctatagctatcttacactttgtccctctctgattgaatcctagttaacaagtttctatgtctcttgtatttcccataaattggtagttggatctgaaggctttatcaggtttgtttgatttttttttttttaattttggcgaatctacttcaaaagtattggcctacctacaagccactttaatgggcccttagtttagtgacctttgccttgaaaggaacttgaaacaagcaaggaagcaccactgtaatctgcttttttgccagaactgtagcatcttacagcttggttagagacatagtaagcagaaattatcaaattcatataatctgtagctataaggcactgtctctctctctcaattatttacatgatttttctttgtaatataactatcatttcagagaacttggttttgattttttttttttaatctttttgagacagagtctcgctttatcacccaggctggagtgcagtggtgcaatctaaagattgctgactgcaacctctgcctcccgagttcagcaattctagtgcctcagcctctcgagtagctgggattacaggcatgccaccacacccggctaatttttttgtatttttagtaaagacagggtttcaccatgttggctaggctggtctcaaatttttgacctcaagtaatcagcctaccttgatctcccaaagtgctgggattacaggcatgagccaccatgcatggccttcagagaacttggttttaggtacttacggattgtctttcttttttttcctcactgcagcctctccctcccaggttcaagcgattctcctacctcagcttcctgaagagctgggaccacaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttt

SEQ ID NO: 60 - DNA, 6110 bp, Homo sapiens
ctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtgccaggattgctgagtattcccagttgtatgaccagattgtattcagagagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagccagagatctgtaaattggactgcagtctgaggtgcccattttagggtttttgtgctagtattcttttatgtcattttgatgcagaaattgtgtgactgttgaaaattaaaatgtagcgggacccattttctgtacgcagaaccctttacctgtattcctggacaaggcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcactttaaatttatcctttccagagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaacgtccattatttaataaagtttgtaaagtacaaggt

SEQ ID NO: 61 - DNA, 5111 bp, Homo sapiens
cacacacacacggaccgcttactccgctctgcctgctcgctcccactgtccccaagcccgccccgcccgcggcaagtgcgtgcccaggcgcagccaccggcgagatcaggagcgcagcgcccgcagcctgagggaaccggcgcagggcagcagcggctgcagctggattcgcgcgccccagcgctcagtggcggcggccgggacaccctgggcagcaccccgcaccgcagcaccccagactacgagcaatcgtgcccgtccccgccggggctggagggcgcagggccgccaccctgcaagttcgtgggcccccggccacccttatgagagaaggcgaagccgggcgaaggagcaggacgctcggcagcaggactcctccgcaagccccgcgggccctctgttcccgcgccccccgggcgcccaagaagcaaaatgcaaccaccgcgctacagctgagaggggaaggggccagcgccatccgctcgcccggaatccggtccccgcggcggctgcgcgtcccggccgcggcccctccggcccgggagtgagcagcagcaggaggagaggcagcggcccggggttggccggggctggggaggagggacgggacggagggagggcgcgggggcggggagggggccccggcggataaagatggcaatgtctctcatccaagcgtgctgcagtctggctctctcaacatggctgctttccttttgtttcgtgcatctgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgttcctgcagaacgcctcagccgtggtcatcttcaacgtgggctccaacaccaacgagaccatcaccatgccccacgcgggtgtagaagacatcgtggccataatgattcctgagccaaaagggaaggagatagtaagcctgctggaaagaaacatcaccgtgacaatgtacatcaccatcggaacccggaacttgcagaaatatcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagcaggagccagctgtaagcagtgattctgacatttccttgatcatggcaatggaggttggactgtctgatgtagaactttccactgaccaggactgtgaagaagtgaaatcttgaaacgacaaatccagaagcaaagagatagtaggacccaagggaaaggaagggaagagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggccttagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggcctttaaaaaccccagctgccagagaccccaacactaagccctaaatctgctgaggccactgctggttattttaagccacatcacacttgcttccacttgccgggcttgattaagggcccacgtgacatgagaagggagctctagggaagccgtttcattcttctgggtcttacagtctttggctgaaattctgaactcagaagtcccctccaaggcatccagtctttggtggttgtagggctggttttaaaaccagataccacattttcttcctattgaaaacaaaatgccagttgcattggtttcccctgggctagaacagtttttttcttacctctgtaagtgggttctgtaaaaaatggaggctttagagaaaagccaatcatttttaagtccaatggcaaacatagtgggggctgcagtagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttgcatctccctaggagtccaatgcttcctgtaatgaaatccactctctatgtgtgggaaaagaggcagggaggaatgaagagagctctgaatcgagaatcctagatgaaccacacgctttactaagcctcggcttcttcatctataatgtgaagggtttaataacatgagtccccaagctcctctggctgtgggaccacagatgagtctttcagaggcaggatccatttttgcagatagctatgacttgtggcaatcaggcttcgtagcttggggaggtagagttacttgacatgtatcatgtaataacagcctttgagacttggcacaactatggtgctgagaatgaaaatctaaatgattgaagttttaagtccaagtaggagttggtttgttttgccttgtttaaaaattgctgttagtcacagagtttgcaatctctggataccttcaaatcctagctctcactgtgggattcttgatctcagaggtgtttatttttcacagtcagcataggcttgcgccactgactcctccttcagtcggctttgcccaaaacaaattttagtattactggtattaagtttagtccagtggaattagaaggataattcaatagcaacagaaatataaattatattccattcccagagagagaatgcgctttggattgtttagtcctctgattaacgagtattttctcttcctgccaagaactaggtgaatcaggaattgattgcatatgcaagccctggccacagctgcacttacaggatgcctcatagacgatgaggggtctgaaaggccaacccgaggctggcagatctgaccccaaggaggtcctgctgcaaaccccctgagcctttgccattcactacttaccaaagtttgtttctggaggattttcctgtagctttgatagttt

SEQ ID NO: 62 - DNA, 5380 bp, Homo sapiens
taatttttttttttccaaagagatgggatcttgctacattgcccaggtgggtctcgaactcctggcctcaagcaatcctcttgccatggcctcccaaagcactgggattacaggcataagccattgcacccagcccttgaatttttgaaaattaggctctttaacacctgcttggacttcaaagaacgaaggtgagtacttacacaataaccaaacagtgcattccttggaaattccaaacctagatctcttgttacatgcttgccaagcttgtcctgaacgttcctaagtgcagcaggaaagaagtggctcagcttgtgctgtgtgtcccctgagtcttgacctgtgactaataactgtttcctttgtgtgcaggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttcctttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 63 - DNA, 5338 bp, Homo sapiens
tgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagataacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagatgatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatattttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggctgttccccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacagagtcataattcaccaagtagtgaatttgagtggagtcaagtaaagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactgttctatgttcactacaccttcagcattggataaaaatcattttctatataaatatcacattgaaatgaaaaaatgatttcttggcagtttaaaaaaaatattttatagtagtttagggagctgctttaagtagtttaaatctggattttcccagtagaattcttctcatctctggctaaacatgtcagaacaaacaaccaaccagtctgtaggcagaacaaagtcctatttcatccgctgggatacaatttcatcttccattcactttgtcattccacctctaagaagacagactatcattcctgaggcatgaaaattctcagggacaaagccatgcctcagtcacatgtgtgtgcagagagaaatgcacctgtctatctaagggtagatttttgatccctgaataattcattgactaaactgacctcttcctcctggctaaataaattaattttgctggcttctctctcagcggtttctattttgtaaattgctgcatgaccaaaatagccccactcaaaatcaattggattaattttaatggtttggttggatgaatattctggatgaatataaaatgtgctgcccttcacagatgacaccactcccctgtcaatcatagcacatgtgtactttttattgttacttaatagtgatggatttgcacttttctatcctcatactctttcctgttttcttctttgtacaattgcatgcaggagggctggatgccagggttaagagagaaattcatgacaaggaaggtaaaattggttcaaatgagcatgtgtcccacagccttagtctccttactcttaaatcagtggagctgtagcttagatgggtcgtttatatgtctggaaaagttgtcataacagtttagaagccaaggttgtggatttgatcttagaatgggcctgttaatcttatagaacccagaaattctgttcttttcatgtactgttgatgaggaatgaggaaagagaatttggagattcagcacaaaaccattgctacttctagaacaaaatctttagaatatgtcctaataacaaaggtcagtaatgtcatcttcatatatgaaggacacatgtgatacattgttcgtggaaatagaaatgtataattatgataaatgtttcacttgaatcttattgtaaggcttttcttgcttttattttttaaagtcagcaaaactcattttgtctgtcatctataagtcatagtgaggactacgagataagttgataagttcaattgatattaaggtgacatggcaatattaataactcaaatgtgaatgtttcaagtattgaattcttgtccctatgggacatttattaaataaaattaatgggactcttgcaaagtagccttaaaagtgttaatgagtctattaataaatatgaacacatactattattagaaccaactttactcatatctcaaatacagtacatttacattactgtagaggatgaagctctaatttctattacatgtaattttctttagaaagagaaccctgaaagctgccagtttttctattaactttgaattattgaaattgtatttatttaattttattgtttttacaaaattgcaccttgtgtccaaagggcgaagatatgacattgcataagggatttatgtttttcaaagagctaactgttttcatatccatactatatacacttgaagcaattggtaggaagagaacctattggaaaaatacgattttcaaaagtaagtattcctcgggatgtttttatataaattatgttttggaatagaacataaatgactttgagttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactacacaactatgatggcatgtgcttataacatttttataacattccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcacccccaccctcactggaattctcaccaaaaatagtttgatacttaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaatccctgtgtatatgaaagtgcataataaatatatttgctttac

SEQ ID NO: 64 - DNA, 5676 bp, Homo sapiens
agcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggatgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcagggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccaaatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagcccacccaccaccacccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatcagggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttcttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggattttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaac

SEQ ID NO: 65 - DNA, 5561 bp, Homo sapiens
atggaatcacagcggcagcggcggctgcggcgcgcgcgagccgagtgtgagcggaaaggggcccggcgtctgcctcgagactgaagaccgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcacaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaac

SEQ ID NO: 66 - DNA, 5654 bp, Homo sapiens
cggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggccttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagctgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaacatgaaaatgaaactctgaatcttgagaatacaaaattaaagcttagattcccatgtagaattactgagtcaaagaatatgaacattttgattgttcttgatatgctttgctacatttcttctgaaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtgatccagagactccatgaaatctatttttttaattcccaagtgtctaaaaagttgaaaacctaaaagattcaagagttaaatgatttttggcatgcacaatttgattttattgccatcaaaagtttcatgacaacttagtcagaacaaaacgtcgatcacctttaatttagcacaggccttccatttatttctaaacttttttttaactcaccatttgactttctgatattgtaaaatgtgtgtgctgtttttttgtgtaattgaagcctctgaaaaaataaatgaggtgggttttgctgtaatgtccctagtacttggctaaagctagtaaaataaagagatcccattcacaattgccacaaagagaataaaatacctaggaatccaaattacaaggaatgtgaaggacctcttcaaggagaactacaaaccactgcttaaggaaataagagaggacacaaacaaatggaaaacattccatgcttatgaataagatgaaacaagatcatgaaaatggctatactccccaaagtaatttatagattcagtgctatccccatcaagctaccattgactttcttcacagaattagaaaaaactacttcaaatttcatatggaaccaaaaaagagctcacataaccaagacaatcctaagcaaaaagaacaaagctgtaggcatcacgctacctgacttcaaactatactacaaggctacagtaaccaaaatagcatggtactggtgccaaaacagatatatagaccaatggaacagaacagaggcctcagaaataactccacacatctacaaccatctgatgtttgacatacctgagaaaaacaagaaatggggaaaggattccctatttaataaatggtgttgggaaaactggctagccatatgctgaaaactgaaactggatcccttccttacaccttatacaaaaattaactcaagatggattaaagacttaagtgtaagacctaaaaccataaaaaccctagaggaaaacctaggcaataccattcaggacataggcatggacgaatacttcatgactaaaacaccaaaagtaatggcaataaaagccaagattgacaaatgggatctaattaaactaaagagcttctgcacagcaaaagaaactatcatcagagtgaacaggaaccgacagaatgggagaaaatttttgcaatctatccatctgacaaagggccaatatccagaatctacaaagaacttaaacaaatttacaagaaaaaaaaccccatcaaaaagtgtgcaaagaatatgaacagacacttctcaagagaagacatttagtcagccaaaaaacatatgaaaaaaagctcatcactggtcattcagagaaatgcaaatcaaaactacagtgagataccatgtcacaccaattagaatggtgatcattaaaaagacaggaaacaacagatgctggagaggatgtggagaaataggatgcttttacactgttggtgggagtgtaaattagttcaaccactgcggaagacagtgtggcgattcctcaaggatctagaaccagaaataccatttgacccagcaatcccattactgggtatatacccaaaggactataaatcatgctgctatagagacacatgcacacgtatatttattgtggcactattcacaatagcaaagacttggagccaacccaaatgcccatcaatgatagactgaataaagaaaatgtggcacatacaccatggaatactatgcagccataaaaaaggatgagttcatgtcctttgcagggacatggatgaagctggaaaccatcattctcagcaaactaacacaagaacagaaaaccaaacaccgcatgttctcactcataagtgggagttgaacaatgagaatacatggatacagggcagggaacatcacacaccagggcctgtcagggcgtggggggctaggggagggataacattagaaattcctaatgtagatgacgggttgatgagtgcagcaaaccaccatggcacgtgtatacctatgtaaccaacctgtacgttctgtacatgtatcccagaacttaaagtataataaaaattaaaaaaaataaagatctgatgttttgttaaacctgataagttttgtactagtaaaattctagaattctaagcatagatttaaacattgctgaaaaatgagtttgtgtgttttatgccttccaggggacagttaagtgggcagtatttatttaatatacctgcttcagccccatttgaattgtaagcactctgaaagcatgtctcatagtcgtctgtatccctggtgtctcccacagtgccctgcttacctgcaggcctttttgtattttctgtccaagtaccctaatagggtggtgcagaatggatgtacagatctgtggatgacctcagcagcttaatccaaggcacccctcgggaagcctgaaatgtctttgaagtcttatgtattatcctaaaatccattgacattttatattctaccctacaaaataagtatgtgttactatttttctttccaaattgttgagtaaaactcactgtattcatcctgtggctttgtactgcccagcctagctcattgttttttacctgcctcatttcctgagctgggcattgctcagtttcagaaggtatcaggtgtcattgaacacctgatatgaaggatgtaaaagttctctcttttctatctaggtgtctatattttaattggaggctagatgatatttgcaacctgtctttatctaaagcattgtcagtgaactcacctacttaggaattcatatgcaccttagttaaaaaaaatgtattgtggttttaaattttttcctcaaccactgtaatatgaagaattctttttattttttaagagattctaagaaaatgttcacattatcaaaactagaattctatcaacttttaagacatttaattatttggaataaaatgtgaatttttagacagaaaatggcaaaaactagtatgaaaatatatcatgttacatgtgaaattatgacagttgttaacctattaagttaatcatgttaaatatgtaataatttggggctaaatgaatgtatattataaattatatcagtgaagatcaaccatgtgtatgctttaattattaattttaaagagtgagctctaagaatgaacacatcagatgtaagtattattttaaaaaatcaaaaagaattatctagttattgtatatatgtttttaatattatgactctggtcctttggaatgaatgctattattgcttatctgtatttttttccttttttctttagaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctct

SEQ ID NO: 67 - DNA, 5072 bp, Homo sapiens
ggggctgaggaggcgagggcagcggagtttcctgccctgagatagttgcagcccgctctgctgcaaccatttcaaattagagaagaaagcagttcagccggtggggctggcgggactctgaccggcccggtggcctcgccggcaacggccccgccccgctggcggcagcggcggcggcagcggctgcgcggggcctggaactggtcgggccggctggggttccgggggacaggtttgcagggtggggcccgagaggctggcgggcaggcagcagtggagccggaagggtaggcagccaggagagagagaggagctatggagagggcccgcaagttctcgggctccggcttggccatgggcttgggctccgcctccgcttcggcctggaggagggcttcgcagaggtgggcctggccgctccgctccctgcggcccggaggggatgccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacaggtcgatcaaaacgaaacgtaaaaagagtttccgcctctctcgaaagtttccattttacaagagcaaagaaaacatggcccaggagagcagcatacaggaacagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctgtcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcac

SEQ ID NO: 68 - DNA, 4397 bp, Homo sapiens
gagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacaagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcgggacgcacttcatcaacgccttcgtgaccacacccatgtgctgcccctcacgctcctccatcctcaccggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttctttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggattt

SEQ ID NO: 69 - DNA, 5484 bp, Homo sapiens
tggcgaggcgggaagcacccggaatcttcctggccctagagcctgcaggctccaggccggccccttgaatctcaccgcgaggaaggcaccctgctgcctgcacttatttgcatccaagagtttgcattgagactggcgcttgcctactagggcagccacaggggggttccccagggacagagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggctatctccccctctggctcagtcatcgcctgcccacccttcacttcttaaaggtgcgcaagagaggagggccgactggagggtgtcgccggaaggtttcagcctgcccttcacaattccccttgtgcacagcccagttttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 70 - DNA, 2374 bp, Homo sapiens
gcgcctccgcccgcgcgcctcccggcctcgcccgagggtgcctgggcaggcgaggaccccaggttcagcagctggacatggagaaccaacgctcatcacctctgtcgttccccagtgttccacaagaagaaaccttacgtcaggcccctgctggactcccccgagaaactctgttccaatcccgcgttcttcctcccaaagaaattccttctttgtctcccaccattccccgtcaaggctccctgccccaaacttccagtgctcccaagcaagagacttctggccggatgccacatgtgctccagaagggaccctcactcctgtgttctgccgcttctgagcaagagacttctctccagggccccctggcttcccaggaagggacccagtatccacccccagctgctgctgaacaagaagtctcccttctctcccactccccccaccaccaggaagcccccgttcactcccctgaagctcctgagaaagaccccctgaccctttccccaacagttcccgagactgacatggacccgctgctccagagcccggtttcccaaaaggacacccctttccagatctcttctgcagtccagaaggaacagccgctccccacggcagagatcacccgcttggctgtgtgggctgccgtccaagcagtggagaggaagctggaggcccaggccatgaggctactgaccctggaaggcaggacggggacaaatgaaaagaagatagccgactgcgagaagacagccgtggagttcgcgaaccatctggagagcaagtgggtcgtgttggggaccctgctgcaggagtatgggctgctgcagaggcggctggagaacatggagaacctgctgaaaaacagaaatttctggatcctgcggctgccccccggcagcaatggagaagttcccaaggtccctgtcacatttgatgatgttgctgtgcacttctcggagcaggagtggggaaacctgtctgagtggcagaaggagctctacaagaacgtgatgaggggcaactacgagtccctggtttccatggactatgcaatttccaaaccagacctcatgtcacagatggagcgcggggagcggcccaccatgcaggagcaggaagactctgaggagggcgaaacgccgacagatcccagtgctgcgcacgatgggatcgtgattaagatcgaggtacagaccaacgacgagggctcagaaagtttggagacacctgagcccctgatgggacaggtggaagagcacggcttccaggactcagagctgggtgacccctgtggggaacagccagacctggacatgcaggagccagagaacacgctggaggagtccacggaaggctccagcgagttcagcgaactgaagcagatgctggtgcagcagaggaactgcacggaggggatcgtgatcaagacagaggaacaagacgaggaggaagaagaggaggaggaggatgagctgccgcagcacttgcaatcccttgggcagctgtccgggagatatgaggccagtatgtaccagaccccgctgcccggggagatgtcccccgagggcgaggagagccccccgcccctgcagctaggaaaccccgcagtgaaaaggctggcgccctccgtgcacggtgagcggcacctgagcgagaaccgcggggcctcgagccagcagcagcggaaccggcgcggcgagcggcccttcacatgcatggagtgcggcaagagcttccgcctgaagatcaacctcatcatccaccagcgcaaccacatcaaggaggggccctacgagtgcgccgaatgcgagatcagcttccggcacaagcaacagctcacgctgcaccagcgcatccaccgcgtgcgcggaggctgcgtctcacccgaacgcgggcccacgttcaaccccaagcacgcgctcaagccgcgtcccaagtcacccagctctggtagcggcggcggtggccctaagccctacaagtgccccgagtgcgacagcagcttcagccacaagtccagcctgaccaaacaccagatcacgcacacgggtgagcggccctacacgtgccccgagtgcaagaagagcttccgcctgcacatcagcttggtgatccatcagcgcgtgcacgcgggcaagcatgaggtctccttcatctgcagcctgtgcggcaagagcttcagccgcccctcgcacctgctgcgccaccagcggactcacacaggcgagcggcccttcaagtgccccgagtgcgagaagagcttcagcgagaagtccaagctcaccaaccactgccgcgtgcactcgcgcgagcggccgccaccgcggtggagctccagcttttgttccctttagtgagggttaattgc

SEQ ID NO: 71 - DNA, 4955 bp, Homo sapiens
ggctggccgaagttaggcggagccccgaggcgggggaggcggggccgggccggcgcagggagagtcactcaatggacaggcgagaaagcaggaccggcgcggcggggcggggccggccgagtccctagagctgggggcggggcggacccagcggaccagcggaccacctgggtgctgtcgtagttggaggtggcctgaggagctcagttccctcagcgcccgtagcttcggcggagtctgcgcgatgggcgacccggaaaggccggaagcggccgggctggatcaggatgagagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctctcgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattaggattaggatgcaaaaataaatgcttaaccaacactactactgttagcaccactactaattatcattcattgataatattaattgcaatgatgttgtaataaaatactctcatttccttaaaataattgtgattctaggtcctaggatctagaattagatctttgtatttttaatgcttaggggaagaatataagtatctccttaaaaagaacataattctcattcacgcaagaataagttctttgaattccttagtatgtagtgaagaaaatttagttgttagttgctttgggaagcctacttatggagtggaaaccaggaggttatcatggtagttgaccttgtaagaaaaatgattcttcttcagaaattaaaaacataactattgccagatttagctctggaatgtttagaatcaggctagaatagcattttccaaagaatattctaagagctattagctcctctagatattttgttgggggaaaaaggggattctgtggtcagatgagtttgggaaatgctgaacacttcattcttctttagcaagtacagtcagtacatcaaagactgagcagttcagtggtacataaatttatctcgccctgcatattcccaacatacttaacacagatgttttttacctgttaacatctcacccagctagtgttcctcagaacaaagattggaaaaagctggccgagaaccatttatacatagaggaagggcttacggactgagaaagggagaacatggtagggattattgaatcatttcaaatttataccaagcctgaatagtgtaccagcaattgacttaggctgtgtttctttatggttttaaaactcttgagctgttataagagatagttcttttaatgtgactatgcaacatgatagccaatggtgagggaaaaggaggtttctctagaagagtctgatgaaaggccgggaaccaaggtttttgagaagtctgcccctatttatttttagtaagtatcaagaggtagcctgagcctagttagagttagacctgtctttggatgaagaagtcttaatactgaaatactgaatttttaatacattattatttggtattctgtataccccttcaagcagttgtttcccattcccaacaaactgtactttatacaattctggatgctaaaacttagagattttctctttgcataaattttggctccattctttccataacaatctaatcaaaactgggagttctcaagtgaatgcaaaaggagcaggccataactttatttgttagagacactgtcagaaacttgagatcttttggcctatgataataccattaatttttgcattgcttcagtttgccaagtgtttttacatcatctcatttgatctcaaaacagcttgacagagcaactgttattgaaatattacagatggaaagaatgaggctcagggaagttaaatgacttggccaagatctgctcatcgtcactgtctgtacagtatttttttttagaggttgtaatgtctcagatttagtcctttaccatctatgttgatttgcttttgtctatttcctcattaattgaatatactttaaatatatatattaaagtatcaaaatatagagagacatttgaactgtattcaggtaatatgtttaaagatatttatatattgccatacaaaaacttaacatttaaaactgataatatctgtaatgacatcagaatgaaagaaaaaaaattgtacagtgtatattcctttgttttgaatccaaatctttttcataggtaatgacagatgccttaatgtgaagcttatttataatagcaataaacctaactggatttggatgaagaagtcttaatactgacatactggatttttaatgcactggtttgttatttggtattctatctctttttccaggcctccaggttgcacatttatttattatgttcaatactttggttcttagttcttaaagaatcaagaagttgtgtaatcttttaaaaatattatcttgcagataaagaaaaaaattaagagtgtgtttacaactgttttctcttttttacagtacatgtatttaaatcattgctataataaagttaagttcattaggaatataaaaacttgcagttctatgatagattgcatttattaaaaatgtttcattgtatcacatagaaatatggccaggaaggacttgagaagacagtttgatccattgcttttagacaggactgggttttgctgtccaattatatacaataatagtttttcttacaactaagctggccccagccttgtcttgatattaatacatgaaatttttataattgtctcattgtctcatttagaaacatccatatttttctgctttttctattgccattttttatttgtgcatgaattgattattgagaaaatgtagcagtttgcatatttaaaaattaatcattttgcattttacatttaaatatgctaacatcgctgtcatagaattcccaaatttcatttgtagatactgaactaagggctaatgtcaggagctgatttttaatgataaagctgcagatgggctaaataaaagccaaattaatcctacaatcaggtattatgtttttaaaccaagttgagtgaattggtagtggacttgggaaatcttccccagcagaatctggatgaatggcacagaattgaaatctctttgtttcccaccatttccctttaagtgctctgctcctttgtaaaaagttaaagatttgaaagagaatctcatattcccgaggcattaggaagaaaggatttaatcccttcaatttggggcttaatcttgtttaaaaaaatgtaagtgaagatggaaggctggagagaatgattgctttttgtacagttaaataaggtcacaatattcttacatactttgttttacaactgtgttttcattttttcaaatgtctggccatttagcaaagttatttactatttactgtgtacatagaaaggtttattatgtgtggtgtatctaaatttttttttgctgaaatacattatggtcaatcaagccaagcctgcatgtacagaatttgtttttttttcaaataaattagttgttttcttatttttttggcttagtatgttgaaataaactatggtatcttcatcattttgtacatttcctttttgaggaaggtttctttataagtgcaagggctaccctaataaaggaatgtatatacttacaaaaaaaaaaaaaaaaaaaaaa

SEQ ID NO: 72 - DNA, 6043 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagtaagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcaggtgggaccggaaccggaacccccctcttcaagtaccttttccctctccgcgacccggccctggcgcccgagaggattcctgggtgggggtgggcgtggagggccgggggctggagaggcactcggccccggagagtgcagcagacagggctggtcccgaggtggatgcggccccggaaaatgggcggctggggggtgtccagggagtagggtcggatcggagtatatggaccaccgggcccggagggtccgagccgagagcggagcctgcaccctccacctcccgcccttcgggaaatatcagaactgagccaggaggcaggtgcaccgggaaaatgtgtctgagtcctgcttggcagaagagaaactgagtcaccagcttaggagtcgcagggtcagcgggcctgaagggggctgggtctgtctgcggtgcggaggattgggtgggcctgtgtgagccgaggtggccgctggctggagattggtttgcacttcttggctgggttcccccgtgctccatgactcctgcatctcctgattgtttctcgttggtttggagttgtccctgcggttggagccatctgagcttgtagggtcgaggcccaggaggaaggggagggttcaccgacttacagcctggctgtaggtttgaacaggagtctgaggtcgctgagggtttggggaggctttcctgagctgctctggccccagtcctggggctgtcaccttccagtattgcgtggcgggaggagcgctaacaagagccaagggttgtaaattccacacccagctctgccactttctagttgtaagaccttgagagggctcctcctttctctaatttctattttagaaaattggaacaataatattcttctcccacatgaagatagtaacaatggcagtcgttcagcggatgcttactttgcgttcagcgctgacataccccattccatgtaattctctcaacatttcgaggggagggatcattagctttgtttaacagatagaaaaacggaggctcagagaggacgtggaatttgttcaagataacatcgctcataaggtggctggactgggtgctcataaggtggtttgagccctggtctgactcaagtccatggccttaaccagaaggctaacctgcctttagggcatactccccagtgggagaagaggaaggtgaaaaatcctagggccccagctctccctgtgatgttttgtttacgtgaggccagcaaagacttgacctgagccaacccagtttctcctctggggcccctgcggcctctggccccagactgaagggataccaaagaagtgggctgtagctatttcacatctccttcacgcagtgcgtgggtgctggactctggggtcagctttcaagacaattactgttttggtccatcatgcatccatcctcattaatgaatcggccccctccaaagagttggaccctaagatgcgtgaggcaggctctctaaggtctagaatcccagctcctctctagccccctgcgagctggggcggtgaggtgctatggctgaggctggcccagccgggccctggggacagggactatgaagtggggaaaacagtagacttggagttctgaaacttttctgagcttcggtttcctcatctgttcgagaggtctttgaaacctctcagggaaaggtaagataaccaagtgggagcctctagaatggctcatgggaagtgtgacatgaatattggaggatccgatgtagagggggggtgatctggaaaagttcccttttttagggggaaggtgctccaaagccctctactgctggatccaaagctaaggaaagtgggggcaaatgtggcaggctcggggcaggttagacgctggggagccagttggctggggcctgcagggtgccaggatctgggagagggaagggaggtgttgggctcccttccccattgctctctgcggagtctgaagtagggtcggacgtctctggctgggggtgggatgcagcctccggtgcgccctcagcagtgaccctcgtgtgtgcctctctcttcctttcgcagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcg

SEQ ID NO: 73 - DNA, 5058 bp, Homo sapiens
ctcagatcctgacggtgcagcagcccgcagcctcagccagggagtcccagccgctttcaatggaggagaagcccggccagccacagcctcagcaccatcacagccaccaccatccgcaccatcaccctcagcagcagcagcagcagccgcaccaccaccaccattattatttctacaaccacagccacaaccaccaccaccaccatcatcaccagcagcctcaccaatacctgcagcatggagccgagggcagccccaaggcccagccaaagccgctgaaacatgagcagaaacacaccctccagcagcaccaggaaacgccgaagaagaaaacaggctatggtgaactaaacggtaatgctggagaaagagaaatatctttaaagaacctgagttctgatgaagccaccaaccctatttccagggtcctcaatggcaaccagcaagttgtagacactagcctgaagcagactgtaaaggccaacacctttgggaaagcaggaattaaaaccaagaatttcattcagaaaaacagtatggacaaaaagaatgggaagtcttatgaaaataaatctggagagaatcagtctgtagataagtctgatactataccaattccaaatggtgtggtaacaaataattctggttatattactaatggttatatgggtaaaggagcagataatgatggtagtggatctgagagcggatatacaactcctaaaaaaaggaaagctaggcgcaatagtgccaagggttgtgaaaaccttaatatagtgcaggacaaaataatgcaacaagagaccagtgtcccaaccttaaaacagggacttgaaactttcaagcctgactatagtgaacaaaagggaaatcgagtagatggttcgaagcccatttggaagtatgaaactgggcctggaggaacaagtcgaggaaaacctgctgtgggtgatatgcttcggaaaagctcagatagtaaacctggtgtgagcagcaaaaagtttgatgatcggcccaaaggaaagcatgcttcagctgttgcctccaaagaggactcgtggaccctatttaaaccacccccagtttttccagtggacaatagcagtgctaaaatagttcctaaaataagttatgcaagcaaagttaaggaaaacctcaacaaaactatacagaactcttctgtgtcaccaacttcatcttcatcatcttcatcatctaccggggaaactcagacccaatcatcaagtcgcttatcccaggtccctatgtcagcgctgaaatctgttacttctgccaacttttctaatgggcctgttttagcagggactgatggaaatgtttatcctccagggggtcagccactgctaactactgctgctaatactctaacacctatctcttctgggacagattcagttctccaggacatgagtctaacttcagcagctgttgaacaaattaagactagcctttttatctatccttcaaatatgcaaactatgctgttgagcacagcacaagtggatctgccctctcagacagatcagcaaaacctgggggatatcttccagaatcagtggggtttatcatttataaatgagcccagtgctggccctgagactgttactgggaagtcatcagagcataaagtgatggaggtgacatttcaaggagaatatcctgctactttggtttcacagggtgctgaaataattccctcaggaactgagcatcctgtgtttcccaaggcttacgagctggagaaacggactagtcctcaagttctgggtagcattctaaaatctgggactactagtgagagtggagccttatccttggaacccagtcatataggtgacctgcagaaagcagacaccagtagtcaaggtgctttagtgtttctctcaaaggactacgagatagaaagtcaaaatcctctggcctctcctacgaacactttgttaggctctgccaaagaacagagataccagagaggcctagaaaggaatgatagctggggttcttttgacctgagggctgctattgtatatcacactaaagaaatggaatctatttggaatttgcagaagcaagatcccaaaaggataatcacttacaatgaagccatggatagtccagatcaatgaaggaccagactgcctattcgtaacctttctgcagcattagagccatcgttcatgggggacacaaggcttttatgctcctagatcttcaacgcagcagaggaaccataagtagaatcacaggataatatatacaaatatatatatatacatatatatatatatagttatttaaaaaaggcaactgaaagtaattagacttcttaaggaatcaaatttatttcaagagactacacatggttatttaatctccggtactgaataggttttttttcttctgttagtttttgtttttaagtgtgaatgcaagtgattaatgaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgccttgttcctattttgatttttgttgagtctcctgcctgcttgccaaaagctaggatgcttcaggcccatgtacaattgaaagcagaggcatccttgagctttaaagcattgaacaaactggaaaatgcaacataccacataactgaagtgaaaaaagtctgtgtttttgtgtttttttaaataaaaattttcaaaaagttaaaaaaaaagacatataaggttgattaaagggaaaaaaggctccagtttgttttacaggttttaaagttctgctgtgtgttcaattgccttgtgtaaccacttgtcgccttagggccagattcccctctctagtccccttttttaaatgtccattttgcttgcctggaattttaaagttcttccgtctcacaactcacaagaaactttctgggtttgtgacatacagaggttgaattgagtatatatttgaaaaggaaaaaacaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagtt

SEQ ID NO: 74 - DNA, 4832 bp, Homo sapiens
ggagccgaccagtttctccttggaccaagatgactgatggaaaactctccacctctacaaatggcgtagccttcatgggtattctggatggtcgaccaggaaacccccttcagaacctgcaacacgtcaatctcaaggcgccccgactcgtctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcctccacgtttcccaggacaggctatgactcggtaaagctctatagcccgacctccaaagccctgacccgcagcgatgatgtctccgtctgcagcgtgtccagtcttgggacagagctgtccaccacgctgtccgtcagcaatgaggacatcttggaccttgtggtcacgagcagctccagtgccattgtgaccctggagaatgacgatgacccacagtttaccaacgtcaccttgagctctatcaaggaaacccgtggcttacaccagcaggactgtgttcatgaagctgaggaggggagtaaattgaaaatattggggccatttagtaacttctttgcaaggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggatgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgtt

SEQ ID NO: 75 - DNA, 5567 bp, Homo sapiens
atggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcagatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagcagccagctcctgtcaccatctctctttcagaggactcctgatggatttgactcagtgccgctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaattatgcccttgcttgtatcttgtttcccaaaatggcccatccgccagagccatagcttcgtctgctcataattcttatagctttggaatgaaaatatttctatcttcttaagtatagaaactatttcctctgtcctctaacttaagggcagaaacagctgggagttttcctcgcatgccctcagctcatgatctcttcaggagagaggctgggtgaggagggtgtcggggttccctggtggataatcttcatagcagcctggatccatttcccctggataaccagctcaaagggagtgaaaatggtagtctgagggcaaggggagcaaggcctgggtaagaaaagccttgaaaagcataaaaagaggccgggcgcggtggctcacgcctgtaatcccagcactttgggaggccgaggcgggcagatcatgaggtcgggagattgagaccatcctggctaacacggtgaagccccgtctctactggaaatacaaaaaattagccgggcgtggtggcgggtgcctgtggtcccagctactcgggaggctgaggcgggagaatagcgtgggcctggaaggcggagcttgcagtgagccgagatcgcgccactgcactccatccagcctgggtgacagagtgagactctgcctcaaaaaaaaaaaaaaaaaagaaaagcacaaagagaggcaacaaggaatgtttttgtttttgagacaggctctcactctgtcacctaggctggagtgcagtggcgtaatcactgttcagtgcagcctcaagctcttgggctcaggctatcctcccatctcagcctctcaagtagctgggactacgagtgtgcaccaccaggctcactaatttttgtgttttttgtagacacggggtttcaccgtgttgcccaggctggtctccaactcctgggctcaagtgatctgtccgcctcggcctcccaaactgctgggattacaggcataagccactgcactcagccttttatttgttttttaaaccacgtagctcattgccttctcttaagtaaatgatagatattctcactgaagccaaaggaataagttcatcaagaaaatgcccaaagccctggtggatacatcctccctatcttttttttaaaccttccactatcactctatgacactgaaaagaaccaggtaagccccaaacccagatgttccagccttatcctctattgggtttacccacagacatagcaaaccctgtcagtgaggaaaattccccatccttgagtgcccccgtcctagaagtttgggccatattatggaacaggggtctcttatttgaaaagagcacaaggaggccaagattttaatggggcactttaggggatacagcccacaatggcatgggcctgaggtggccgtgatgtctgcttctaagcttaacgcatctgctcaggcacagaataaacgtctaggctggccaaaaaaggaactgaatcccaggcccatacgccagcaccagaatcaaaccagtcttcaaggaaggaaggctaggagagtttaacaagattttcactgggcccagcatggtggctcacacctgtaatcccaaggcagaatggtggcttgagctcaggagttcaagaccagcctgggcaacacagtgagaccctgtctctaaaaaatttaaaaataaacaaggtgttcaccaagctgggatacttctcactattaagcccctatctttctctttttttcattctcaattgctttgtgtgataaaaaactaaagagacttctggtccaatttctggcaacatcccttctgaaaggtgagtagagtgggtgtcttctatgcccattttccccaattttacacaaactattatcaatgaacttttaagtacctagaatgggtaaaaccagagcaagactttaaattaccttcttctttcttctactggcagttctgcctccatcactatcaggctagggtgaccttcccttggtcaagccccaattgcccatgatttgtgcctgtgccctttctccagtgaccatttggtgaccagatggtagatatagaaaggggatggcatttgcaagtgactagtctgccacaaaatgctcatctgattagccactgctgccctggcaatggctttgtaagagtcaatgagaactagagccaggctgtggtccctggccatcaacagtgttggtgacggcagggagtccctttggtttaataaatccagtttttctttgggtatccaaattctcccctccttttgtaggagtcaggctctcagaacctgtgtccatgttggaacttcccccagtgtggatgcagatacgcagctcctgagctccagcctaaagtcttctgtagcctcagcaatacttgggcacctgctgtctcactgaatagctttcttttgtgacaaaggccacagacagcccttagactattccggaaacagtaggaaaaattacatatgtctttgacttctttattctgactccactgattttagccataatactttaaggagctactttttactaccccttaccgtgctgacttctgcaggtctgccctgtgacctgtcaggaactcctgagttacgctactggggtcacctgttgctcccctagcaagttaggcatgtcatatatttttaacagctttattgagatataattcacatattatacaattcacctttaaaacatacgattcaatggttttcagcaaactcacagagttgtccgcccacttgagagcaaacacatgttcaattttcttttcctttttttttttgagacagagtcagctttgtcgcccaggctggagtgcagtgccatgatcttggctcactgcagcctccccatcctgggttcaagtgatccttctgcttcagcctccccagtagctgggattacaggcatgcgccaccacgcctagctaatttttgtgtttttagtagagatggggtttcaccgtgttggccaggctggtctcaaactcctggactcaagtgatccacccacctcggcctcccaaagtgctgggattgcaggtgtgagccaccgtgcctggcctacgtgttcaattttctatgaacaaaggctttagtccttgacccagggctaaagtggtctgtccaagctgttgttggtagagggagtatgataaaatgtttaaatctcatttggttaccttgagtcctggaacacgcagtaactgtcatgctatagtcatcatctgtatttggctgggaatacaaatgaagattgtggtgtattcaagcagtagggtttttgcttttgtttttgttttagtgccaacaaaacttttttttgtctgactacattaaagataagactgactatatttatacaacagaaactttgtaatagattttttcagctttgtgaaatcgaattttttttcatcagggctggttggatttcctttttaccctgtaatccaagcgttaatagtttgttagaagatgggttattgcatgtcacttttttttttttgtaaaataaaaacataccttac

SEQ ID NO: 76 - DNA, 5123 bp, Homo sapiens
atttccatcaaccatgatgaaagtctgctgcctgagtccttagagagcatgatgtatggtaagaaggtgctcagccaagaaccaagctcttttcaggagagcccaagtaccaatactgaatctagaaaagatgttattaccatctcaataagcaaagatgggaactgccagtctggtggccctgaggcagaaatagcttctggccctacttttatgggtagcttagaagcaggaggagtagctcaagcaaacatcaaaaatggaaaacatttgttgatgtctatttcaaaggaaggggagctctgctgcagtgaggcaggacagagacctgaaaacattggccagctggaagccaagtgtttagcttccccttccttgaatccaggaaatgaaagtgggtttgtagatatgtgcagtcttagtgtctgtgactccaaaagaaacctgtcatcagatcagcaattaattgatttattggaaaacaaaagcttagaaagtaaattgattttgagtcagaaccacagtgatgaggaggaagaagaggaggaaaacgaggaggaaaacttagccatggcagtaggcatgggggaaaggccagaggtattgcatctcacggagcccactactaacatctcaagggaaaagaaccaaggcttccaagatgaaaccaagaaaggaagcttagaggtggcaaaccagactcctgggctacagagggctttccccgctccagcagcctgtcagtgccactgcaaacacatggagaggtggatgcatggcctcgagaatgatgaatttgaaatcgagaaacccaaggcttatatcccagatctgttcaaaagtaaaaccaatactatcgccatggagggtgaacccactgctattccatcacagccgtttaaagtgaagcatgagcttttaaaagaaccttggaaagaaagtgcagaggggcaaaacgttttccccacatatcctcttgaaggaagtgagctcaaatcagaagacatggattttgagaataaagatgattatgatagagacggaaactgccatagtcaagattatccagggaagtactctgaagaggagagcaagagctcaacatcgggcatcacaggagacattggggatgagctacaggaggctcgagctcccactattgctcagctgctacaggagaaaactctctattccttctctgagtggccaaaggaccgcgtgataattaaccgcctagataatatctgccacgtggtgttaaaggggaagtggccctctagccagcagtatgagccctcaggcacactgcccaccccggtattaaccagcagtgctggttctcgaaccagcctctcagagccggaagcagcagaacacagcttcagcaacggcgcagcattggcggcccagatccacaaggagagcttcttagctccagtattcacaaaggatgaacaaaagcacaggcgtccctatgagtttgaggtggagagggatgcaaaggctcggggcctggagcagttctctgccacccacgggcacacccctatcatcctcaatggctggcatggggagtcagctatggacctctcctgctcatcagaggggtccccaggagccacatcccctttcccagtgagcgccagcacccctaagattggggctatcagttcacttcagggagcccttggcatggacttgtctgggattctgcaagctggcctgatccatcctgtgactggacagattgtcaatggaagcctcagaagagatgatgcagccacgaggaggcggagagggaggcggaaacatgttgaaggagggatggacctcatctttttgaaggagcagacacttcaggcgggaatcttggaagtccatgaagacccagggcaggccaccttgagcaccacacaccctgaggggccagggcctgccacctcggctcctgagccagctacggcagccagcagccaagccgagaaatccattcccagcaagagtctgcttgactggctaaggcagcaggctgactactccttagaagttcctggctttggggcaaatttttcagacaaaccaaagcagaggaggccacgctgtaaagaacctggaaaattagatgtcagctccctgagcggggaagagagagttcctgccatccccaaggagccaggactgagggggtttcttccagaaaacaagttcaatcacactctggctgagcctattcttcgagatacgggcccccgcaggagggggaggcggcctcggagcgaactcctgaaggctccttccattgtggcagactctccctctggaatggggccactgttcatgaatggactgattgctgggatggacctggtaggacttcagaacatgagaaatatgccaggcatccccctcaccgggctggtggggtttccagctggctttgccacgatgccaacaggtgaagaggtcaaaagtaccctgagcatgctgcccatgatgctgccaggcatggctgctgtgccccagatgtttggtgttgggggactcctcagtccacccatggcaaccacctgcacttccactgctccggcgtctctatcaagcacaacgaaaagtggtacggcagtgactgaaaagactgcggaagacaagccgagtagccatgatgtgaaaacagacactttagctgaggacaagcctggtccaggtccattttctgatcagtctgaacctgcaataactactagtagtcctgtggcttttaacccatttctcatcccaggagtatctcctggactcatttacccatccatgttcctctcccctggtatgggcatggctctgccagccatgcagcaggccagacactcggaaatagtaggtctggagagccagaagaggaagaagaagaagacaaagggggacaaccccaactcccacccagagcctgctcccagctgtgaaagggagcccagcggtgatgagaactgtgccgaacccagtgcccctttgcccgcagagagagaacatggggcacaggctggggagggggcactcaaagactccaacaacgacaccaattagaacttttttcatttaagaaattattgtgacttgtaagtttcttatcccataaaggtttgttacttccctcacttcacctccataagaacctgtgtttccataagtaagattacgtacctgatttcctgtctgagaactatggtaacagatgttaatagttgcagggtctcaccacttcattagataagtgttgtctacctagtctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatggttgaaaatacatatattcatttctttataaaaaacaaaaaccttaccggtagtaatataatttcccccttggtggtttttcagacacctgcagcaagaagaaatactgactgactaggcattattttctatacatccctctcaccagtgaaaagattcctcttgctgcgagaaagctttacccaccatgagttattgctgtcgacgggggtggggcaaggacccgcgctccgtagagctacacgctgcttcacaagcacacggccagcgctctgctctcacctggttcgcttacagatttctctagccattaatttgcctctctgtgtttaaagagcaccaggaccgaatggattttcacttcaggctttccttcaccaagaataaggttctttctggagcctgcaagaagacagttgcccaacactttgacacttgctagtaggtcctttgatcaagagtgtctgaggctgtcaaatgtgtgccaccctttataatacagctatgaaaagttacttctccattaatttctccattctgtttatatcttacagttggacccaaattccaaattatcagttaatcgaaactacattgcaagtcaacattattttctcttcttcctcagcttctccatgtttaggaactgagaaagaacctgcctaagcagcacttccccatgtcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcacgtagaaaaaaaaatgtatttgccctaaatccttaaaatacaaatgctataaaaattcctgtatcttgaaagccttactgcaaatgagtattatagacatccc

SEQ ID NO: 77 - DNA, 4135 bp, Homo sapiens
tttttacatgccaacagtaaactctttaccagaactgagtcctcagaaatattttagtacattgcaaccaggaaaagcctctttagcttatttttgtcaagctgattccccaagaacatctgtatttcttgaagaactgaatgaggctgttagacctctgcaggactatggaatttcagttgccaaggttaattgtgtcaaagaagaaatatcaagatactgtggaaaagaaaaggatttgatgaaagcatatttattcaagggcaacatattgctcagagaattccctactgacaccttgtttgatgtgaatgccattgtcgcccatgttctctttgctcttctttttagtgaagtgaaatatattaccaacctggaagaccttcagaacatagaaaatgctctgaaaggaaaagcaaatattatattctcatatgtaagagccattggaataccagagcacagagcagtcatggaagccggttttgtgtatgggactacataccaatttgtcttaaccacagaaattgcccttttggaaagtattggctctgaggatgtggaatatgcacatctctacttttttcattgtaaactagtcttggacttgacccagcaatgtagaagaacactaatggaacagccattgactacactgaacattcacctgtttattaagacaatgaaagcacctctgttgactgaagttgctgaagatcctcaacaagtttcaactgtccatctccaactgggcttaccactggtttttattgttagccaacaggctacttatgaagctgatagaagaactgcagaatgggttgcttggcgtcttctgggaaaagcaggagttctactcttgttaagggactctttggaagtgaacattcctcaagatgctaatgtggtcttcaaaagagcagaagagggagttccagtggaatttttggtattacatgatgttgatttaataatatctcatgtggaaaataatatgcacattgaggaaatacaagaagatgaagacaatgacatggaaggtccagatatagatgttcaggatgatgaagtggcagaaactgttttcagagataggaagagaaaattacctttggaacttacagtggaactaacagaagaaacatttaatgcaacagtgatggcttctgacagcatagtactcttctatgctggttggcaagcagtatccatggcatttttgcaatcctatattgatgtggcagttaaactgaaaggcacatctactatgcttcttactagaataaactgtgcagattggtctgatgtatgtactaagcaaaatgttactgaatttcctatcataaagatgtacaagaaaggcgagaacccagtatcttatgctggaatgttaggaaccaaagatctcctaaaatttatccagctcaacaggatttcatatccagtgaatataacatcgatccaagaagcagaagaatatttaagtggggaattatataaagacctcatcttgtattctagtgtgtcagtattgggactatttagtccaaccatgaaaacagcaaaagaagattttagtgaagcaggaaactacctaaaaggatatgttatcactggaatttattctgaagaagatgttttgctactgtcaaccaaatatgctgcaagtcttccagccctgctgcttgccagacacacagaaggcaaaatagagagcatcccactagctagcacacatgcacaagacatagttcaaataataacagatgcactactggaaatgtttccggaaatcactgtggaaaatcttcccagttatttcagacttcagaaaccattattgattttgttcagtgatggcactgtaaatcctcaatataaaaaagcaatattgacactggtaaagcagaaatacttggattcatttactccatgctggttaaatctaaagaatactccagtggggagaggaatcttgcgggcatattttgatcctctgcctccccttcctcttcttgttttggtgaatctgcattcaggtggccaagtatttgcatttccttcagaccaggctataattgaagaaaaccttgtattgtggctgaagaaattagaagcaggactagaaaatcatatcacaattttacctgctcaagaatggaaacctcctcttccagcttatgattttctaagtatgatagatgccgcaacatctcaacgtggcactaggaaagttcccaagtgtatgaaagaaacagatgtgcaggagaatgataaggaacaacatgaagataaatcggcagtcagaaaagaaccgattgaaactctgagaataaagcattggaatagaagtaattggtttaaagaagcagaaaaatcatttagacgtgataaagagttaggatgctcaaaagtgaactaattttatagggctgtggtttccaaaatttttttggcatgatagacttaatttatttccttaaagaataatattaaatcatttcaagtttgcagactagtgccatccaatagaattataatataagtcacatattttatttaaaattttctagtaactacattaaacaaagtaaaagtgagcagggcaaaataattttgatattacttttcacccagtagtatacccaaaatagcgaaatatagaaattattaatgagatattttacatccttttttgtaccaagtcttctaaatgcagtacatattttatacttactgcatttcttacttccgagtagccatatttcaagtgttcattgccacatgtggcctgtgactactgtattggacagttcagtactagacaaaaactagcataattaacttagttctagccatgatttctatttggattaaaattaaactctaatcacagttaactccacagtgcattcatgcagctgacagttatatttgttttattggagtcatgatattaaaatcagcgtttgtcaacctcaggggatatttagcaattgtcgggagacatttttgatgtcatgactagggcagttattgacatttagtgagtagaggccatggatcctgctaaataacctgcattggacagcgccccacaacaaagaattatcctgcccgaaatggtagtcgtgccaaggctgagtaaccttgtgttaaaagtaacctgtggcagactaggtttccagaatttcctggttctgctcacgtatcatgtttgaaaaaattttggctattaaagatatgtattagatggtcttatcctgattattacctggatacaacttgatcttttctaatattttcagaaagtgatgggataaccctagaagaggactcagaatgatatttatattttaagtgagtcttaaaacctcctcttatttctacaagttatatggctaaatttcagattgaacagggattcagcattctgccatctcctcatggaaagagaggctccctcatctgaagcgtctctgaaatctacccttgcaagcttcagacaaatcagttgatctccctgagccacacggcctcattctgtgagggagggaaagattagccaaagagttaattttcattccaaatcacttagctgttagactgatctgtttgtagcagttgtttgtctcatttttgctctgtgcattttttgagacatttgttgagaatattctatttggtgctctactgtatttttctttttaatatctacttgatatcttgttctttaaattttcttcacatatggtttgcctgatacaactgatttttataactgaaatttaaggaatctaacagctaaaactcagtaagtgcatctatttccttataacatagacccgttgctactctcagcaccctctcctcaattttttttcctgtagcatgtgatgcctgattaaactcattttcatttgcttttatttctaatatgggaacaatgagagtgaactctaaatataggttgtagtaataaaacatcattagcctaattattagaaaatgctaattaagtaccagcacatagaaacatgaaattgcttagtcattgtacctttgtcagcaattttgacagtcattaatgtttgtcataattttaaataaagtgtctgggtttcagaataccttc

SEQ ID NO: 78 - DNA, 4022 bp, Homo sapiens
gcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccctggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttaaccagagtttaaacttccattaggcaatttcctgtcacttgaaatgtcaacatttgctaacttttggatatccttttggttacaccaaagaaaaagttatggctattttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcatt

SEQ ID NO: 79 - DNA, 3863 bp, Homo sapiens
gcggttgccgcaggaaggctagccagagggtaattacacagcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgctcaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagt

SEQ ID NO: 80 - DNA, 3771 bp, Homo sapiens
cagtctgctgagtctaggctgttttcctcagcactgactgcatggcagctgtgtgctcagcccgcacaggcaggctgtgttgtggggtccagaggggctgatacatgtaaagttgatggaatatcctgctcaatggtgaatacgacctaagtgttagctgctgttatctcctttaatccatacaagaaccctctgagggaggtattatccccattttacagaggaagaaactgaggcccagagcggggaagtggcttgctctgggtcacacagcaaggacttgctggagccaaagcttctggcccaggggcagtgcccttccaggcagaagcagctgaaagccttgttctggcattgcagcccagtgtggaggggcgagacttggggtgctgagagggcctggctcccttcttggtgggctgggagcctcagtgtctggcaggtggctgtgctgggcttgtgcatttcccagccatgtctggttcagcccacagaccccggggctgccctttgcaggtgtgagtcaatgtgggaacccaggacattacggatagcccctgggctgccctcaccccagcattttgggtgtcccttgtccctgtgtcactgtcactcccctcaccaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaatgtgaacctgctgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacacccaagtgtcctggttaacttgaagcagccgagatgggcacacacgggtctttgcctccccctccttccctagcaggctccccatgcgggaagatctgatgatgttcaggaaacaggctagacctcagctccaatgttttgacatcaagtactattttccttccgactgctgtacggtataaagcacagcaggatccaagccttgcacaaaggggtggggggggcagtgtctcctctggctgtcctgtttgtttgtttctcatatgggggtggggggtacctgcactgtctgtacctttctgagaagaacagagaccgagacctgcccccttaccaagcgccactgcatggtttgggggggggggggcggggggctagcttctcacagcaggaggcctttgcccccacagcccctccacgcctgcctcagggcctgagaagccaccacttgtatcccccttgtggttagagtcctgattttactgcaaaggtgttcatgttccttgtgaagtgtgggctcttaggaagcctgtgggctcctctgagcagttggcctttgtagctgcaacagcagccacctgcaggttgggtgaagtgccctgacactgctgtagcccccttctaacttctaaccgaagacaagacagacacccatgttcataaataaataaaagtaagcctaagc

SEQ ID NO: 81 - DNA, 4052 bp, Homo sapiens
ggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaggagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcagccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatcccggacgccatgtgggagttacttaccaatgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagagggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttct

SEQ ID NO: 82 - DNA, 4193 bp, Homo sapiens
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccactcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattattt

SEQ ID NO: 83 - DNA, 4220 bp, Homo sapiens
cacagcggacctacaggcgctcagagaagcccaccttccccctctctgtcccgagaaggcttagagtggtacctgcttgctcaagcaacctgctgcctccacccagagcagccgctcctctcctccctcccttccggaagatgctgaggatgacagcttttagcctgactcttacatttctttggcagagcagttagaggccagactgtcctgtgaaggcttctccttccttcttcctctgctcaggagaaaacttacaaacttttaaatgtaagaggcagatgagctgggaacctggaagtgggttgcatctgactctgaaagttcctccctctcgctggcattacctcatgctgccacaaagtgaacggatcactggggaaggcagagtctccccggcactgctgggaccctcccttgaagagcccccatgtcctgtaggcagagccttgtagtctgtccgcttggttactgactcgggctgtctgaccagcccctcttctgtgccttgtctgaggtccttgtccatctctgtgattgggcagcttctctctctggattgggtcacgtgaagcgggaaactgaagccattactctccaaaccctgtttcatcttcccaagcatgtcggaaagctggcaacagccgccacagacgcagccgcagcagccacagccaccgcagcctcagcaccatgcagagccaccgccagccctggcagagcacacgctgcctccgggcacggcggagaaccccctgggctgtgctgtctatggcatcctcctgcagccagaccccggcctgcagcccccacaacacgcacccctgcaggcagcaggagagccaggccccaaatgtggcgtgtgtggtcacgacctggcgcacctgtccagtccgcatgagcaccagtgtctggcgggccatgaccgctcattccagtgcacacagtgtctcaagatcttccaccaggccactgacctgctggagcaccagtgcgtgcaggctgagcagaagcccttcgtctgtggggtctgcaagatgggcttctcactactcacctcactggcacagcaccacagctcccacagtggcctggtgaagtgttccatctgtgaaaagacctacaagccagctgaggcagcggagccagccaccacagccgccccgtcgcttcccgcagcacccgcgccttccactgtcacccctgctgaacaggccgacaagccctacagctgccccatctgccaaaagcccttcaagcacctgtcggagctctctcggcatgagcggatccacaccggtgagaagccctacaagtgcacgctgtgtgacaaaagcttcagccagtcgtcgcacctggtgcaccacaagcgcacgcacagctccgagcggccctacaagtgcgcagtctgcgagaagaccttcaagcaccgctctcacctggtgcgccacatgtacgcgcactcgggcgagcaccacctgttccgctgcaacgtgtgcgagttgcatttcaaggagtcgtcggagctgctgcagcacccgtgcacgccaagtggggagcggcccttccgctgcggcgagtgccagaaggccttcaagcggccctcggacctgcggcagcatgagcgcacacacagcgccgagcggcccttcaagtgcgacctgtgccccatgggcttcaagcagcagtacgcactgatgcgccaccggcgcacacacaagaccgaggagcccttcaaatgcggcctatgtgagaagggctttgggcagcccagccacctgctctaccaccagcacgtgcacaccctcgagactctcttcaagtgccccgtgtgccagaaaggctttgaccaatctgccgagctgctgcggcacaagtgcctgcccggcgcggccgagcggcccttcaagtgccctgtgtgcaacaaggcctacaagcgcgcgtcggccctgcagaagcaccagctggcccactgtgcggcggcagagaagcccctgcgctgcacgctttgcgaacgccgcttcttctcctcttccgagttcgtgcagcaccgctgcgatccggcccgcgagaagccactcaagtgcccagactgcgagaaacgcttcaagtacgcgtcagacctgcagcggcaccggcgggtacacacaggcgagaaaccctacaagtgccccaactgcgacaaggccttcaagcagcgggagcatctcaacaagcaccagggcgtgcacgcccgcgagcagcagttcaagtgtgtatggtgcggggagcgcttcctagacgtggccttgttgcaggagcacagcgcgcagcacagtgccgccgccgcggcagcggagggcgcctaccaggtagccgcctgcctgccctgactctgcggctgtggcccctgccagcctgacctgagtcggcgccgtgggcccagcaggcctcgcgcagcctagctcctcacagctgccttgcaccaagggccccacccagctcggtgttctgagacctcgggagtgaggacgcaggggtatgaggcagggagagggtgtgccgctcgtactcctggcaccagcgggcagtgcgggcggccagattgctgtggcccatccggattccacaaacctctttcccatgacaagattcactttcttgagagccatcagcaccccccttatttccggggcactggagccaggctggaagtcaagtggcttctccctgccctaaggagggtgtgatgccagcccagccttcccatatctttcaagctagcagccacataggttaggaaagcggaggctcatggtggggctggggccccagaggtgggctaggtgtaaggcatcagttgccgtgtgggggagaaggccagctttaagacgtaggcctggggactgggagggcagagggtgagtcacagccctctccgtctgctctagccaggggcgacgtgtccccaggtttctggcaggggagatgtgcagggtgggtcttggggctgggtctgcctggagaccagtgggcccagggggaagggggaagctgagaagttcgtgtgacaccctcagccaagggacagtgccatccttggggacaggaggaaaagcagcctgtctctgctaagggcaaatcctccggttttggaagcgcccctcccacctttgtagtgcagttcctaggtgtggtggggaatgtgccgtgctctcagcagacagaactgctggtgtgaaaggcagggattgtcagcccacctgaggctgggaggaagcaggaccaggcctaggatctccccagcagatgcaaacaagtgtcctcccctgaattgtgtgaaccaaagcgtcaggggcttggggcacagccccagtcagctcaacccagtcctgcttcagagccaagactaggccagggtggggacccccccagtaccctccctacatcaatgtggctgctggcctggaccccaggggtctggtacagccaagatgttctggacaacatccagctacttcaaaggccagagtgtcctttgggtcctcctagagtccccctaggtctctggctgcccatgaggctcatgaagcagagggtatcccagtcatagggagcagaaagagcaagtgggttaaggaagcctgtgggggacctggtggatggagttgaccaacatcgctgggtggctacggccctccttaggaagcccagaaggacctttattattaaaataatcattttgaaccctgctctatcccctgccctcttccagccccacccctccctggtcttgaaagaagactaatcagtgggcacaccaagggccctgaggggcagggagatgccaccatgcttctctgtcaccgtaagaaggctgaccagccacgcccacctcctctgtctgactgagttccttcctgtggccacagggaggggctggtccttccccttggtgctggctctctgtcacaatgcctcaaaagacatggaacccaggcctacaaccgtcccaactgctaattcttttcctttcattttgctttctgaaagcagtttgttatactattcataacattgtagagtttaatttcatgtcattttggatcttatataaaaatgtgaggatttggatttttaaaaagaatgactccattttaggtagccacttttgatgttaatatatagtgagtccaatgtatgctttagaagtaaagacattgaccgtcacagaccactgc

SEQ ID NO: 84 - DNA, 5480 bp, Homo sapiens
gtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaatggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacacatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcccgcttctactaaaaaaaaaagagcacaaaagaaaaactaaattattgaaaaatt

SEQ ID NO: 85 - DNA, 5390 bp, Homo sapiens
gccgcggaggcggatgggcgcggctccctcccccactcaggcctcttcacggggcggggggccgggtcccccagcccccacccgcgccgtgtccagctcctcgcgtgctcgcggcggagccctgagcgcactgggtccgagtcctgcgcgccccctcaccacctcccccgcacctgctcctcctcctcggtcccgcccagcgcgccagcagcccgatccccagtgctgggagaagagagggggcgcaggcggcgacacaaagggtggagcggcgggaccgggacccgggaggctgcgcggcatggacgccgagtaccctgcctttgagcccccgctctgcagcgagctcaagcacctgtgccggcggctgcgggaagcgtaccgcgagctcaaggaggacctcacgcccttcaaggatgaccgctactacaggctggcgcccatgcggctctacacgctctccaagcgccactttgtcctcgtgtttgtcgtcttcttcatctgctttggcctgaccatcttcgttgggatcagaggacctaaagtgatccagacttctgcggctaatttttcactaaataatagcaaaaagctaaagccaattcaaatactttcaaatccactgtctacatacaatcagcaactatggctgacatgtgttgttgagttggatcaatcaaaagaaacttctattaagacaagctttcccatgactgttaaagtcgatggtgtagctcaagatggaaccacgatgtacattcataacaaagttcacaaccggacaaggaccctcacatgtgcagggaaatgtgcggagattattgtggctcaccttggctacctgaactacactcagtatacagtgatagtgggatttgaacacctgaagctccccatcaagggaatgaacttcacatggaagacttataaccctgccttctcccggttggaaatctggttccggtttttctttgtggtgctcaccttcatcgtcacttgcctgtttgcgcattccctccggaaattttccatgagagactggggcatcgagcagaagtggatgtctgttctcctgcctctgctgctactttacaatgatccgttcttccccctctccttcctggtcaacagctggctcccagggatgctggatgacctctttcagtccatgttcctgtgcgccctgctgctcttctggctgtgcgtgtaccacgggattcgtgtccagggagaaagaaagtgtttaactttctatttgcctaaattcttcattgttggactattgtggttggcttctgttacgctaggaatatggcaaacagttaacgaattacatgatccaatgtaccagtatcgagttgataccggaaattttcagggaatgaaggtcttcttcatggtggtggcagcggtgtacattctgtacctcttgttcttgatagtgcgggcgtgttccgagctacgtcacatgccttatgtggatctcaggttgaaatttttgactgcattgactttcgtagtacttgtcattagcatcgccatcctttatttgagatttggggcgcaagtactacaagacaattttgtagcagagctgtcaactcactaccagaattcagccgagttcttatctttctatggcctgttgaacttctatctctacaccttggcctttgtatattctccatcgaagaatgccctctatgagtcccagctgaaagacaatcctgccttctccatgctgaatgactcggatgatgatgtgatttatgggagtgactatgaggaaatgccgctgcagaacggccaggccatccgggccaagtacaaggaggagtcagatagtgactgagccccggccagcccagcgaggcgacaagatgcctggatgctttccccggtgaccgtctgctgaccttcccctgttatattcagatttttcttacaagcagagatttcctgttcatttgtttacatatttttttaaaggaaaaccaaaactgagggtaaatttaaatgtttagccaaatttattgtcatggtggctacgagaagaggcattgataacaagtttcaacagccaaatccttttttacagagatttcagatgagcgtgttttcagtgatgaggaaatttcacgtttttagtacagtgaattatgtacttttttttcctgtaatcattcactgattccaagttcacgggcagcctgtgactaggtcctcagcgtgacagcatcaccctctttcttcccttttccatggtactgttttttgaccctttaaactcaaagggaagccttatctgtggctgcttcagggcagtccttcctcgttgagtggccagtgccctgggtaaccaggtggctgaagtgattggtcagttatgtggactgcattttgtgcagtgtgtgagttatgactcatcgggaatgggagatgctggggttccaacccttcacgtcaccaaaggggaagtaatagtgtggagttctgaggagggtttgataagttgaataaggaaaggctaagataatttacaggttaccaactcatgtggggaaggtcttactgccatggtgcttttcaggggcctgtgtgtacacacatgattaaatggatttgcctgtgggaggtatgggcaggagaggaacccttaccattccagtaaatagcagtttctgcaattctgttgaatatgaaatgccatagagctttatttatttatgtaagtaaaagctaaatgaggggccaggtgcagtggctcacatctgtaatctcaacactttgggaggccaaggtgggaggatcacttgagcccaggagtttgagaccagcctgggcaacacagggagaccccgtctctataaaacatttagaaagttggctgggcatgctggggcatgcccatagtcccagctactcaggaggctgaggtgggaggattgcttgagccctggaggtcaaggctgcagtgagccatgattgcaccactgcactccagcctgggtgtcagagcgagaacccgtgtcataaataaataaagctacatgaaagattgatagaatattttagattatttattggccaaaagtttttaaaactcatatttggaagcaaaatgaaaagcaagtaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagctttcccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtgtaggaccttagagatgttcatgagaaactatttgttatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgttttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagaaagtacttaaggggaaaatcgttcttactaagtcatgtattttcaacttgtcttccctgttatatcataaataccgacatactacataccccatgtaaaattttgcttaaactctctagcacttggcatgtagaatatgtaccataggtatcaggttaaaacactaaagtctgccagaaacttttgacagtagcaagaaaattgttgaagaaaaaataaattatttactgagggtagttatgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattacagcagtgaagtggtgccattttctctctcttaagccccatttgaaaggctagagaaggggatatatatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttaccttagaggttagacttttgaagaaaaaaaaaaaaagatacagatcttttcccctggccaaagggaagttgtattagtctgtgacatcttgtgatgctgtttatcttggtttgacattggagatacgctagtaactgtgataccatactataaaacagaagaattttctgctactaaaaactgcctttttacaaaatgactgtaaatatttgtaaaataaaataacactaaactttaagcccaaaaggagagatagagccatgtgttcagttgtggacctgtccgtggggcacagtgccaccccatcacagtgttgctgtcatcaggcaaaagtgaatgtttgtttatggcaaattcgtcttttgcgaatggcttaattctgacactacctttctgggaaatgttaataaatttttaatattc

SEQ ID NO: 86 - DNA, 4655 bp, Homo sapiens
cccgatcagcaagtggagactgggaaatccccctctttatctggagcctctgccaagcctgcccctcagtcgagtgaaaacgctggtacttcagatttagaactacctgtcagtcaaaggagtcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtg

SEQ ID NO: 87 - DNA, 5145 bp, Homo sapiens
ggcggcgggagagctgctggctcgcccggatcccgggagctgcctggaggcgggcccggcccggggaaggtgagcggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaagcatttcaaaaatgatgaaggaagtgaaagtatcctggatcaactcctagagttagagattgcccaggtggaaagaaaccttagccagcgttcaatcaagctcaccatgcagggcagtcacccggcagttctcaaactttagcatgtgaagagtcaccagcagattcctgggctcgcctggagacattcctagtcggtattcctggtcgaagcccaggagccttcctttttaacaagctgatgtagagggtggagcactgtatgtggagaaattccttctacaatattccacacaggtttttggccacagtccttgatggagtcccaaaaccatggtgcagccagttccaatgctggacacctcaaccatcagggtgaaatctggggcctcagctttttaatttaattattttaattcttaatactttaatttgtgcatttcataagccccctgctcttggactgaattttgtgctttttattgaagaattttattgtttttatcttaaaatcagtttctattatccttggggagaccatccctaacaaagtacaggtgggatctcctgtgagtcattggctgggttctgattgctagatgtcacacccaccagcatcaccaaagtgactctgagatagaccggtcccttctcagcgttccagtcacttcaggaggaatttagttattgacttagtctatgacatctggctacatgtaggtagagaagaaagacaattttaaaaaggaaatcaggtcttttgcaactgtgcctccctctgtctgttttcacttgaatgggtaaataaccagcagctaggttttgaattcctaccttgttattctaaacagatgtccacattgttaattaaatctaaattatgagccttgctgagtggatacggtacttacacctgaaccaggattcctgggttctgttgttgacattgcccttcagcacctgtttggccagctgtataagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctgtctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccaaaaagtgccagaagcatcgtggcatttccagaaccatggattctgcctttggacccctctctattaatattaaaactctgggccttcagatgtcaccctaatccactgccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaacctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcctttcattcttcttcttcttttttttggggggggcggggcgggggagggatctcaaagttttagtcttccagaatccaaattaaaggttgcccctgatgggggccaggttccgccacagaacatcttagatgtcagccttgacctcacttagcagggattacagaaatgagatacattttgaaggagagttgtctgttatgttcactgtattctaagtgcctgggataaagctgtctcatgggtgctccatatatattcatatatatttgttgagtgaattaatgaattaagagtggctggcagagtaggcagaaaaagacactgcaaatggcataaaaattaaagtcctagctgagttctcaatggtaaaggcatcagatgtcttagcagtcaagctagaaattcatgacaatgagtattactatttgcctaatgacaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgactccacctcttgcatcaaatcaatatctatttgttgagcacttattgattaagaccttgcatatgtctgtccattttgatttgagatacaactttttgtgtgggttgaatgacaaatcactccaaacaaaactgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacagggt

SEQ ID NO: 88 - DNA, 2782 bp, Homo sapiens
gcggccgcggcggggcggcgcgggaaccgggccccggggggagtcggccgggctgctgctgctgctgctccaggtgctgccgcccggggctacggcagggccgggacgccggggcacgcggggcgctggcggcggcggcgtctgctggcccggcgcggccccagcctttccccgggacgcgcggctgctgctgctcctgccgccgctgccgccactgtcgccgccgccgccgagctccgcgcccgcagcctccgcctcccggatggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacactccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccaaggagcgccttcgcccccgtgctgcgccccccaagctccccaccccaggcctgccccagagcccacggagaggggcttccagaccagtcttttgaggattctgacaagttccactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctcctt

SEQ ID NO: 89 - DNA, 3239 bp, Homo sapiens
gggcggccgcaccgggcagcaaccccactcccactcggaggccccctgccctctcccccacttccccccggcccatggtgcgaggctgggagccgccgcccgggctggactgcgctatctctgaagggcacaaatcagaaggcaccatgcctcctaataaagaggccagcggtctcagtagttcaccagcggggctcatctgcctccctccaatctctgaggagctacagcttgtgtggacgcaagcagcccagaccagtgagctagacagcaatgaacacctgctcaaaaccttcagctactttccctatcccagcctagcagacattgcccttctctgcctacgttatgggttgcagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcgggacggcccccagaggaggtgcctcctcctccagtgccagctccagagcaagttggtattggaataggtcctccaactcttagcaagcctacccagacgaaaggattgaaggtagagcctgaggagccctctcagatgccaccactgccacagagtcaccagaaattaaaggagtccctgatgacacctggcagtggagcattcccctaccaatcagatttttggcaacatcttcaaagcagtggcctctcaaaggagcaggcaggcaggggtcccaaccagtcacatggcataggtactgcttcctggaaccactccacaaccgtcccccagccacaagctcgggataaacccccaccaattgcattaattgccagtagttgtaaggaggagtcagcatctagtgttactccctcttcttcctctacctcttcttctttccaggtactggctaatggagctactgccgcctctaaacccctccagccactaggctgtgtcccacagtcagtgtcacccagtgaacaggcattacccccacatctggaaccagcctggccccaagggctacggcataactcagtaccaggtagagttggccccacagagtacctttccccagatatgcaacgccagcgaaagaccaagcgcaaaaccaaagagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctggtgcccctagtttccaagacccagcaattcctacaccaccaccatcaacccgctccttgaacgaaagggctgagacaccacctctgccgatccctccacccccaccggatatacaacccttggagaggtactgggcagcccaccaacagctacgggaaactgatatccctcaattgagtcaggcatcaaggcttagcacccagcaggtgctggattggtttgactctcgattacctcagccagctgaggtggtagtttgtctagatgaagaagaggaagaggaggaggaagaactgccagaagatgatgaggaagaggaggaggaggaggaagatgatgatgatgatgatgatgatgtgatcatacaagactgagtggggagctgggggaggggaggtctgttactgaaagatgaaccaacttagtaactgtttaaacaaagaaaccacatttttaaaattaccttgtggcagagaactaaaaagctttgtgttcttcagggtgggtggcagggggatatagtgagggtggaccagggagaatgaccatagggcactaagtaaggctgggattggatcagcagaaatccaaccctctaaccttagggtagggagtgctaaggatctggggaaaccatgggctgggaagctgctcttgctctcctcgtgtctgctgtttttttcccttggtgtactatacagaggccagatgttggcaccacctctccaggaggattggaaaggaggagtaaaggattctgatttgattgatgattccagtgcatccccaatcccaccatcttacctggaatataaggctgccttgtaccccttttctgagcacaagtctgtgcgtaatgcaactgactctcttacttttttcttagtaactgatcatttcctagacaaccaagattctcaataagtcccagtctcatcacaaatattaatatttccttttcctcataccaacttgactatgtttcacccgcttcatgactaaatcacaggtggcagaatttttcagttcttttttttttttttgaggtggagtcttgctctgtcgcccaggctgtagtgcaatggcgcaatctcagctcactgcaagctccgcctcccaggttcatgccattctcctgcctcagcctcccgagtagctgggactacaggcacctgccaccacacccggctacttttttatatttttagtagagacgggtttcatcatgttagccaggatggtcttgatctcctgacctcatgatccgcccaccttggcctcccaaagtgctgggattataggcatgagccaccgtgcccggctattttcagttcttatgctgtgaccactttgccttgtagctttttctatctttccaaaatcctcactctgttcattgtttgtctcagggaaaatcttcccccaccgagcttgtaaaaaactttaataattgggtggagaataatttagaatggatatttattggaggtggtaattagggaagatgtccttttaaacagtagaattgtgttacaaaggggtgaaagagagggaatagtttctccttgttgaagggcagtgaaggtaggtttcaggtttggttttacaaacctgttaactacctcctgtccagcttgacagagactaatttttcatctttttgctgtcaatttgtttccagaaaagagacttttccctctcttgataggatctgtcttagggacagagggaccatcgtctttaagtgaattaattattgatgttttagaatggttttcatcagttgggatcagctatatggcaaataggtatcatcaatgagttaaccatctaaaaataaaagagtggaagccctaaaatgctagaataataataaaaaggccaaaaat

SEQ ID NO: 90 - DNA, 5536 bp, Homo sapiens
agcaaacaaactcttctagagatatttttggtaaccacagtgaataaaagattgactgttagtaactattttcatttactagactgccctgaactactcatctgtgagttgagtattttttttttaagtgaaagcatgtttattaagaaaataaaggaataggctgggtgcggtggctcacccctgtaatcccagcactttgggaggccaaggtgggtggatcacctgaagtcaggagttcaagaccagccgggccaacatggtgaaaccccgtctctaccaaaaatgcaaaaattaggtaggcgtggtggcaggtgcctgtagtcccagctactcgggaggctgaggcaggagaattacttgaacccaagaggtggaggttgcagtgagccgagatcgggcactccagcctgggcgacagagcaagattctgtctcaaaaaaaaaagaaacaaagaaagaaagtaaagcaataaagaatggctacttcataggcagagcagctgagtattttcttttcccagcaacttttatctcccgaatagaaattctttctaatcccacttactatttggaattctaaatccaacattgctttcccagagatccatgttatcaagatttgcttgtattagttaagagcgattgcttattatctatacagcccttgaaattacattgttgtgaagtcaggctgctgttttagggctaagtaaggttttctgaaaaagaggcaatggtgcaaagacagctggaaagacagagttaaacataccttttaaagtggatcaattttatgtaaccagagtatgatctttctgttttatgtgtttattggaagagttgtcacttaaagtgatattcctcaaatagctaaaaatgtcctgggttttctagatagaaaatatctctaagttgtacttattaaaatgtgacttggggaattttaaattatattcagtggaagtatatttgcccagctttatttttgttcgggtaatttatttctcaaaattttggaggtgaggtctttattgatttgtgtgtgtgaaaaacaagacaaaacacacccactatgaggatcctttaaaaaaaaagctttcttgttatccagataacacactttaatcgtacgacggaaatggatacatttaacatgacaaaaaatagcaaaatcctctgctcatggaaagatgatttccaaaccctcttgtcttacagaagaaaacatttggttgactaagaactgacatggtctgctcatagggattcttagcatttttaacatcatccctgtttgactgcttctttttctacattctcatcttctaacttttttctagggctgctctttttagtaaagctaaacaaaacctggcgtcctacagccttactaacctttgttaatccgcctgctcgtcacatctttgtatggcatctgtgctcactcatgggggaaagagattctggaagaagcaacagcaataaccaaggcaaatgtggggaagtgtctgcatgggttgttagcatgatgtgtggggcctaggttttacttcattttcttcgaatagtgaggtcgttaagtcacgccatttgaataattttgtatgaccatagggtgacatactcatccctgttgtcaattctcctaagaaatttggtggcaaatttcatcacttaagccagaaagtggaaatttggattagggatgccaaataagcaaatctttatattgatagaaatgtacataggcgtatgtcttaatagacttccacattattgaggggttttttttggttttgttttgttttttagtttttttggtcttatttttaaatttggttaaggcttttttgcttgctttttcttcgatttaattttccttttttacattttaattttggttattttggggccattttttgattttgtttttccaaaggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaagaagtcaaaaagcaaaataacatgaaagacgaggagataaaagtcttaagaaataaaatgctcaaaatggaaaaagtcttgccactgatcggatctcaggaacagaaaagcccaggaagccacaaagcaaaggagcctgttggtgctggtgttagtagcacctctgagaataatgtaagtaaaggagacaatggagaacttgcaaaagaagaacgtgtttcccagctgatgaatggggatccagcttttagacgtggacgtctgcgctggatgaggcaagagcaaattcggtttaagaacttgcaacagcaggagataacaaagcagcttcgtcggcagaatgtacctcataggttcatccctcctgagaaccggaagccccgcttcccctttaagagcaaccctaaacacagaaactcttggagtcctgggacacatatcatcataacagaagatgaggttatagagcttaggattccaaaagacgatgaagcaaggaaagggaataaagaagagagccaagaaaaagggggtaaaggagcttttaaggatccccagtttccatggggctctcaaggaatgagaagtcaagatcacatccaagttagcaagcagcacattaataatcagcaacagccacctcaactacgttggagaagcaattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacagacttgtcccatcttgatgtaagtttgttatgtttttataatgcctataaattaatctgacatccagaaagacctgcctcttagtttatgcagacattcaaaaggagaatttgataagcagaattaaatgtctgttattcataaatgttagaaattggtttaaaaataataacatgcaactgggtgggcacagctttggatttctcatccacgtctgttcccttctttaaatatgattagaattttcgtaagccaaaactaaaggtcttcaaacatatcttgcaatacatagctttgcatcttccacacaacttccacgtcttcttttattctgtattttacaaaaaactcatataatggttttttcttttgaatgtatcagaatatgtatgaaatttgtcatatcagaatctataaattggcactgtgtctgggattctgtttgtggtttgcattttgaagttcaatgtatcatttgacacacatgcacacaaagtgaactattcaccaaaatcatgccaacagaaataccaacaaaaaacttgtgtagcttgtaaggaggttatttggcttgagagggaagaggtgggacagacatgggggacaaagctacagcatatggctctgtggtgctgcttttttccaatagttgatgaaatagtgaaataaaagttaactttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtcttccaaacggtgtgaaaaactacagccaagatagcagttagcattcaaggaagccttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttattttctaagattaaaaataataattgctaggtttggtggcacatgcgtacagccccagctacttaggaggctgaagcaggaggatccctagagcccaggagttctgggctgtggtacactatgccagttgggtgtaagtttggcatcaatatggtgatgtccctgaagcaggaaaccacaaacttgcatcaggacgggtgaacccagcccaggttggaaatggagcaggccaaaactcccaggctgatcagtaatgggatcttgcctatgaatagccagtgcactgcagccaggacaacagagtgagaacctgtcttt

SEQ ID NO: 91 - DNA, 4114 bp, Homo sapiens
gggatgaatggcagcacactgtggtctagtcttctccctgaggaggctcgagatatcacatgtttggagctgatgccaggaagcttggctgaaaccatctgccttgtgacagggacacacaagatgctcagcgcattcaatgcaacgtcagggaaagccatttggactttaaacccaaactacttgtccaacggtaccttggctgccccagttgtggtactgccagacttggatgaagacggtgttcgagaccttgtggttctggccattggggaattgcagccagatctgtgctttctgctggtgtctggccggaccggaaatccagtgggtcgacctgtgaagtacaacatcgttggagttgggaatctgattggtcctcaggtttacatcaccacaaatggggctgtctacatcctgtttggctttggaaatatacaagctgtcgcactgcgggacatttttgttcaggcccaaaatcgagacagctcaccaccttctctgcagatagaagagccagaatgggaaaagcgaagatccatcaacctgtctgagctcattgatgtttacagtgatggtgttgaactactccagatggtgaaggcaccagattccaactgcagcaaccttctgattacaaccagacaaagccttgtgctgcttcgggggcaaaatctgacaccttactgggcattgagacttcaaggcctgcgcagccagcctactcctggatatttcactgatgatcagacattagacttccttctgcagatacaggatggagttgggatgaaaaagatgatggttgtggatggtgactctggctccattgtttggagttaccgtgctccgtgtcacatgaaagaaacgccagccacctcagcagttacttcagaccagaagtctgtcttcctcttctgggccgaagggctgtcagctgcatctcccaattccgatatcatcctaggaactgagccgcccagccttcaccacctttacctcctgcatcctgcgttcccctccatccttctggatctggccaacaccaccggcacagtgacggcttcagaggttggaattaacgacctctggaaagatgccttttatgttaccaggacaacagggccaagctccgaaggccatccagcagccctggtggtcagcaagcttagtctacggtgggcactaatggagggccagatggctcagctacaggagtccacccccaaaattggccgtggggagctgcgaagatttctctctaggataaagtttgttgaagctccctacgagatctaatctgatggaatcttcagttgcagaagaagtgaacagagtggataccctctctactctcctgtcactgtaaaatcagttctatggagagaagacttcttcgtcctcatttaccacctccctgatggttgcaaaggcttgggaaggcatgttggagtctttgacggcagcatgatctatttggctggggcatcttacctaccttttcagtccctgcattaatcccctctaggaactctgcgtggaccgtttggaaatgtgaatctcttaagtatttaatttttttggtatgtctaatttatgaagtcttgctgggaaagccagtgaagtctatgactaggaaacattttgttgtacattgtgctgtgtgtgtgtatattttagtgttgtggtgaagttattttccaggtatgtcctaagcttcagggatccagtttcttgtccttctgaaatatatctggtttgtttggtcattttgagacttccagatgccctacctctgatgttgagggccacttatttctctccttattctttcccacctgtaccttggctacttccaaattgtagacagaatgagaaagatttatagtggaagactgagttagccatccaagcattttcatctctcttgttttatatcctatttccttagattttccatccatgtctattaagtgaccacaagaataactatattcctatcacaaggggagcaagaggatgtagtctcagtgacccatctctgaccaagtccacatgttgtgttatatgtggctctgatggttctgccagtcatgatcttttttctgtggcgacatcagaagtgtatgtttgcatgctgtcttcaacttagaggagaactggaagtcaggagcctttgatgtccttatcctgctgtatgtcttctctgcatctttttctatagggcaccctccttagctcccctcactctgttttctcttctattcagggatatgtttctggactttttcttctgctacttgagtccaggatgcaaccattttgtcctgcatctcttctttcctgtagagcctttgaagcattgtattttgggaaaattcttctgtaaatactataacttttataaatggttaagttatttagaattatctccagtgcttacttctcccttcttctgtataaatctgctacttcaattaagttctcctctaaacttttaggtcattgtttatatagcagaaaattcaatgttagcggatggaaaactgcttcttgaataaccttgataggtcatccctgagtgcacctcaggttctctctttacctgggcttgtatcttttttttttttttttttttttttgagacagagttttgctcttgtcgcccaggctggagtgcagtggcacaatctcggctcactgcaaccttcgcctcctgggttcaagcgattctccagccttagcctcccaagtagctgggactacaggtgcccgctaccatgcctggctaatttttttttttgtatttttagtagagacggggtttcaccatgttggccaggctggtcacgaactcctgacctcagataatccacctgcttctgcctcccaaagtgctgggattacaggcgtgagccaccatgcccggctgggcttgtatcttttagcttgtgttagtaaaaggattctagaaaattatgaagtccagattcaaagggatctctgttaattacccactgacaggcattatgacctaacaggaggttggtagcagtagatccaagcatgcatgttgcctggcctgtagattggccttatcaggtttctgggtgcctctgccttaagatcctgaaggcaaattttgtttcaacagtttggaagtcatctgtgggtccagcttgactttggaggaataagaagatacttctagagtatgggaatgattccagataatttctgggatttgaatctacttgagtttaagggcctgggacctaatttggtttagtatagaatttgaagaattaatttataggcagctgaatacccaaaacttgggtggtggtcctgtggtttggctgagctgtccgggcataacctggttctctgttatgttaaggctttctgggaagccagccactctgcgcaggagtgaaacatgaagttgttttctgaggacctgttttggtgggattgtttgggcagaggactgtgtttatgcagggcaaatcccagaaagataagaggaagctagagaaacttaatgtacctgaattcttcatggtgtatttgcaaactaacttaacatagattcttttgactatggtaagtttgaatctctccttgccaaacaacattataagtttagttttcttcttcctcttgcagccggtacggaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaatatgaccactactgagaaatagtaatgacttctacaaatgcaagggtcttaccctcctctttcccttaaacaccctcccttttccttagaccccgtttttgccatcccccaaatgtgtggtatggtgaaactaatcccctgaatgtgaattgctatccttattgccctattaaagaagagccagctggtatattgtcaggaagcactatttaaaatgtgaactgttatagagtaaataaataaatactctacagg

SEQ ID NO: 92 - DNA, 4755 bp, Homo sapiens
aagagatcttccaggctctcagagccctgggagggcgatttccaggaagaccacaatgccaacctctggaggaggctggagagagaaggcctaggccagagcctgtcaggcaactttggcaagaccaagtcagccttctcatctctccagaacattcctgagagtctgagaagacacagcagcctggagctaggccggggaacccaggagggttaccccgggggcaggcccacctgtgcagtcaacaccaaggcagaagaccctgggaggaaagccgctcctgacctcgggagccatctggaccggcaggtttcctacccgcggcccgaggggaggaccggtgcctcggcttctttcaacagcacagacccaagtcccgaagagccgcctgccccctcgcacccgcacacatccagtctgggccggagggggcccggcccaggcagcgcctcggctcttcagggctttcagtacgggaagccccactgctcggtgctggagaaggtctccaaattcgagcagcgagagcaagggagccagagaccgagtgtgggcggctctggttttggccataactataggccccacaggaccgtctcaacttccagtacttctgggaatgacttcgaggagacaaaagcacacattcgtttctctgagtcagctgaacccctaggcaacggggagcagcacttcaaaaacggggagctgaagttggaagaggcttcccggcagccctgcggtcagcagctgagcggaggagcgtcggacagcggccgtggcccccagaggccggacgctcggctcctccgtagccagagcaccttccagctctccagcgagccagagagggagcccgagtggcgggacaggcccggctcgcccgaatcgcccctgctggatgcccccttcagccgcgcctaccggaacagcatcaaggacgcacagtcccgtgtcttgggggccacctcctttcgacgtcgagacctggagctgggggcgcccgtggcgtcgaggtcctggcggccacggccttcctcggcccacgtggggctgcggagccccgaggcgtcggcctccgcctccccgcacacgccccgggagcggcacagcgtgacccctgctgagggcgacctggccaggcccgtgccccctgccgcccggagaggtgctcgccggcgcctgactcccgagcagaagaagcgctcctactcggagcccgagaagatgaacgaggtggggatcgtggaggaggccgaaccggcacccctgggcccgcagagaaatgggatgcgtttcccggagagcagcgtggccgaccggcgccgtctcttcgagcgcgatggcaaggcctgctccacgctcagcctgtcggggcccgagctgaagcagttccagcagagcgccctggcggactacatccagcgcaagaccggcaagcggcctacctccgccgccggctgcagcctccaggagcccgggccactgcgtgagcgcgcccagagtgcctacctccagcccggccccgcggcgctcgaaggctccggcctcgcctcggcctccagcttgagctcactgcgggagcccagcctgcagccccgcagggaggccacgctcctgccggccacagttgcagaaacccagcaggctccccgagatcgcagcagctccttcgccggtggccgccgcctcggggaacggcgacgcggggacctgcttagcggagcaaacggtggaacaaggggcacccagagaggggatgagacccccagggagccatcctcctggggggccagggccgggaagtccatgtcggccgaggacctgctggaacgctcggacgtccttgcgggccctgtccatgtgaggtccaggtcatctcccgccaccgcagacaagcgccaggatgtgcttttggggcaagacagtggctttggtcttgtgaaggatccatgttatttggctggtcctggatctaggtcactcagttgttcagaaagaggccaagaagagatgctgctgctcttccaccatctcacccctcgttggggtggttcaggctgcaaagccattggtgattcctccgttcctagtgaatgtcctggaaccctggaccatcagaggcaagccagtaggacaccctgccccaggccaccactggcaggaacgcaagggctggtcacagacaccagggctgcacccctgaccccaattggcacccctctgccttcagccattccctctggctactgctcacaggacggtcagacagggcgacagcctctcccgccctacacccctgccatgatgcacagaagcaatggtcacaccctgacccagcctcccggtccaagaggctgtgagggcgatggcccagagcatggggtagaagagggaacgaggaagagggtctcgctgcctcagtggccacctccttctcgagcaaagtgggcccacgcagccagagaggacagccttcctgaggaatcctcagcccctgattttgcaaacctgaagcactatcaaaaacagcagagtcttccaagtttatgcagcacttctgacccagacacacctcttggggccccgagcactccagggaggatctccctccgaatatctgagtctgtcctgcgggactccccgccacctcatgaggattatgaagacgaagtgtttgtgagggatccgcaccccaaggccacgtccagccccacatttgaacctcttcccccacccccacctcctccaccgagtcaggaaaccccggtgtatagcatggatgacttccctccacctcctccccacactgtatgtgaggcgcagctggacagtgaggatcccgaggggccacgccccagcttcaacaaactttctaaagtgacaattgcaagggaaaggcacatgcctggtgcagcccatgtggtaggtagtcagacactggcttccagactccaaacttctatcaagggttcagaggctgagtccacaccaccctccttcatgagcgttcacgcccaacttgctgggtctcttggtgggcagccagcacccatccagactcaaagcctcagccatgatccagtcagtggaactcagggtttagaaaagaaagtcagtcctgatcctcagaagagttcagaagacatcagaacagaggctttggccaaggaaattgtccaccaagacaaatctctagcagacattttggatccagactccaggctgaagacaacaatggacctgatggaaggtttgtttccccgagatgtgaacttgctgaaggaaaacagtgtaaagaggaaggccatacagagaactgtcagctcttcaggatgtgaaggcaagaggaatgaagacaaggaagcagtgagcatgttggttaactgccctgcctactacagtgtgtctgctcccaaggctgagctactgaacaaaatcaaagagatgccagcagaagtgaatgaggaagaggaacaggcagatgtcaatgaaaagaaggctgagctcattggaagtctcacccacaagctggagaccctccaggaggcgaaggggagcctgctcacggacatcaagctcaacaacgccctgggagaagaggtggaggctctgatcagcgagctctgcaagcccaatgagtttgacaagtataggatgttcataggggatttggacaaggtggtcaacctgctgctctccctctcggggcgtctagcccgtgttgagaatgtccttagcggccttggtgaagatgccagtaatgaagaaaggagctctctttacgagaaaaggaagatcctggctggtcagcatgaggatgcccgggagctgaaggagaacctggatcgcagggagcgagtagtgctgggcatcttggccaattacctttcagaggagcagctccaggactaccagcacttcgtgaaaatgaagtccacgctcctcattgagcaacggaagctggatgacaagatcaagctgggccaggagcaggtcaagtgtctgctggagagcctgccctcagatttcattcccaaggctggggccctggctctgcccccaaacctcacgagtgagcccattcctgctgggggctgtactttcagtggtattttcccaacattaacctctccactttaacctcttctaaaatacccaaccaaaagatcactgtttctctcaacactatttaatctgaaaaatgtttcagtacaaaccactgtttgaactatctgggttattggtgtttgttcctgatgaaaggaaaaaaattctctccaggaggaagcctttttccttcttgcccttcctgattgatcttctgagagctcgaatgctgctggacacgtacccctttctattattactttgtagtagaaagaaagttaatgaaactgagaactgattggagggtgtttgatcatttagtttttaacaggctgaggcaacatggatcagtgtgtgtccccctcaggaatgtatccacagtggccttccttgctggtgggcagtgtatcctgatggcagggtacaagtaccattaatgaagggtctgcaacataaagccttaaaaagacacacactaagaaaactgtaaaaccttgaacattgttatttatattttttaaaatggaaaagatcactatgtttgttgtgctaaccacttatttgattctgttttgtggtggacatagatgattacgtttgagctttgtattttgtgaaaaccttaatgaaatgaattccaaagat

SEQ ID NO: 93 - DNA, 4768 bp, Homo sapiens
tctgcttggcttgtggacaatcagagcatagtttttctctttccatcaggtgagagataacagtatcctggttgatcaatgttttcttctttaatcacagatgatggaaagagaaaaactatgctctgcttggcttgtggacaatccatgagaacagagaaaggactgaaacaattgcttccaggggttccattcctctgtatttcaggcaccaagactcagaagcccttcttacaagggcccttcaaggtcatcagtgtggctgaggttgatttgtcgtgtgacaaggctgaaaaaactctaagttactaccaagcacgtctattgtctttacggatgaagacctgcacgcaagctgcatctcacagtggcatggcagccacacaccagaaggcagtgaaaataattgcatacaaaaatggggatgggtatcgtaatgggaagttaattgtggctggaacattccccatgcttcttacagaatgcacggaacaacttgggcttgccagagcagcctccaaagtatataccaaagatggaaccccaatctttaccttgcgtgatttggttttatgggctctagatgaatcctttctccagagagactctgagaaacaaaagcaagatgcagctcctgttggaaaagaacagataattgttgaaagtatggaagaaaatccaagaatgaaagtgaaaaacagattatttgcaaaatctgtgacatccgatagtttggatggtatagacaagtctttgcttaccctcatcctcagaaatcctattgccatctgggtgtcttgtggtgaaccatttctacctccaaatgctttgcagaaagcagaaaaattagagaaacagaactggctaaaaaaggacagaattttggctgatctagataccatgagacacaaaatgagacagttaaaagggcggcgagtagcggcatgtcagccagccaccatggttcctaccaagagccctgtgcagcccgtggtggttgaaggaggctggaccgaacagactcaacaggaaattaaactcatggaacttataagacatacagaggcacacctttctgaaatccaagaaatggaatccaaaataaattttccaattgcaaccaaacgtatagcagtcaagccgagcaacctgtataagcagcccaacacaaaacgagtgtggatttatctaaatggaggcagacctgaagatggcacttatgcctggggcaaaactatttcagaggtcagcttactttatctgaagacatggatctttatttggagcaggaaagttttcttctattttttgataactgcttaaggttaatgtattctagattcctctccagtaacaccaataatgtataggtttaatatctgatgtcttgacattataaatgtttgacttttctctctcatacactttgtctcttttcctttttctgtatcctgtgagatcttctccacctagtctgccctaataatgatttgaatttctgtaatattgagtcttttttctttcttaccttctctcctcttgtcattcagctctctcttcatcctcacttgaaaccctatttcttctctcactagcagctatacaactttggttattatatttaacctctttgttctccatttttctcatcaacaaaaggtggatactaattatttccacagaacaaaattagattgttcttgagaacttttagaaaaatacccagtccctagaaatgtgtcaatatgttttaatcagtattactgttatcagcagcctcagcatctctcctgtatctgagcaatactcctttcctttaagctgtggttgtctcgtttctgtgtgtatctgtgagtatatttacacacagaagtcatatttttttgaatttaggggtaacacaacacagatacttttgaaaatgtactcctgctgtaaatctttttcaaaatcttcaccttgagtacaatgtaccctttttttatgttgtagaatattttcattagctttacattgttgctattgttgatttttctatttatatttccttgtacaaggagagatcttttgataacagacagaataggttagttctctttggtgaccctagacatctacttgggagctgtcagaatcctccctcaatggtaggttgaaggattggtttgtatgcagagtatttaatcaaattgcttctgactggatggtatttggcaggagtagggctgcatttaaccaacatggcacatgtatacatatgtaacaaacctgcacattgtgcacatgtaccctagaacttaaagtatgataaaaaaatatataaaaatagataacattaaaaaaagactactctcctgttggtcctctctgactatcctattctatagaggggaatatatttttggataatttgaattattattaaattcaatccactcatcccttactcaaaatactgggtgaaaagctgcgctttttgaactgcatcgccccatcactcttcttgtcttggctcatattcctgatgcatttgccagatgcaaggtgtcatcacatgcccagccctgacccctgccattctgccttgttgtgagttgtagcatctaaacagatctataaacagaagtattgatggtgatttggagggctgatgtggacttggcacctgcattttgggggaacaggcttttggccctctaataggtgaaagccatacaggcagctgctgcaagactgctcctctcgtctcaaaatgacccacccagctagagcactgtacacccccagtggagagccaattcagtcctgggacgacatagagcgagatatggtcatctgtgtgtctatgggacatggtttcaaaaccccaaaagagttaaaacaactgatggagatcagagcaaattatgccagaatccgaaggcagcagggccctcaagccacagacattgtggtgtcaccatccacgaagctgctgtctctggcacatctccacaattaactcctatcagaaccatcggattttctgctgtatttttctggaaagaaaactttctttacccacttataaacagaagactgtgacaagaaggccaattatttccatcgctgaagactctaaatttggcaaatcttctaaataacaatcctgcatagtttattaaaaaaaattagtcgtaaaatttatccttcaaaaatctgcattttaaataaaccctgacagtgatttctcaagactgtaaagatattagtctgagaatgcaactctaacagactgctctgggcatcttttctctttgccttggccaggcctctcagaattgagtgagcgtgtgactccatttgcacagtgggacagatgagtacaactgaaataaaaagtggaggcctctgcaaaaaataaaaaataaaaaataaatttatccttcaaaataactcagttttttcaatgggcctattttgaagaatgaacattgaaaaatgagacaatatatccataaattcatagtatgacataccataatcgagagcattgttagccatagacattttgtatgccagtgaaatctgtatacattctctaaatttttccagtttatcgtgtggcttattggaaaaaaaaaaagcatatacactgactgcatgttttgtctccccaactaaatgataagtgcctagagggcaggaacacccttggttttatttacttgggacagagctctacccacaagggctcactgataaaactcatcagtcccaccccacagcaacatgatggggacatgaggttcagttcttctactcttggcctgagccgcaaaccaaaattacaacagtacaatgggaatagaggatctgctttatagaatttcctttcagtcagctgctcagaaactacaatcctcagagtgaaattaaatggagttatactgggatagtcctctctgcttttcagaggaaagaaacacttctcgaaattgtgcaaatgaaagaaatgtcatggtataaactagacatcttatatccttaaaatatatctttgatgattatacatattggtttcaaatcccaagtttgaagaaacatccaaaagttatgtgaaattacttatagatgaattgacaacatttgagacttcgacaggcaatcatgaagcagttctcaagttgatttggtttatatagctctttaagaatcttttggaaagccataatctcacaaaatacagatatgcaattttttttttttgagatggagtctcactctgttgcccagtctggagttcagtggcgcgatctcagctcactacaagctccccttcccaggttcaagcaattctcctgtctcagcctcctgagtagctgggactacaggcgcctgccaccacacccagctaacttttgtatttttagtagagatggggtttcaccttgttggtcaagctggtctcaaactcctgacctcaggtgatccactcgcctctgcctcccaaagtgctgggattacaggcgtaagccaccacacccagcccaaaaaatgtttgtgcacagaactgtggatgtttgtcacagaactttccaaataaagaagttctgataaaagagaagatatttctcatttccataatctttaaggtgtgggggatacgtaatctggacttctcaaatggatgatttctaaatacgcgtcagatgaagtgattctaactttctctgtagtaatatcttattttgttttattcaaaaacaataaaccatgtagatttatt

SEQ ID NO: 94 - DNA, 5294 bp, Homo sapiens
ggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctagggctgtttaagaagaagggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcagaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 95 - DNA, 2614 bp, Homo sapiens
ctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgagctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttttgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagtgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagcc

SEQ ID NO: 96 - DNA, 575 bp, Homo sapiens
ccaccattgagaacgccaggattgtcctgcagatcaacaatgctcaactggctgcagatgacttctgaaccaagtttggtttgagtgtttgggtgctggatgaggtgaccctggccaggactgatctggaggcacagatcaaaggcctgaaggaagagctggcctacctgaagaagaagcatgaggaggaaatcaatgccctgaggggccaagtgggagaccaggtccatgtgagggtggattcagctcggacctgccaagatcctgagtgacaggcaaagccaatatgagatcatggccaagcagaactggaaggatgctgaagcctggttcaccagctggactgaggaactgaaccaggaggtcactggccacatagagcagctccagataagcaggtccgaggtcactgacctgcagtgcaccctccagggtcttgagattgagctgcactcgcagctcagcgtgaaagctcccttagaaggcacactggcagaaacagaggcatgctttggagcccagctggtgcagatccaggcactgatcagcagtattgaagcccagctgggcgatgt

SEQ ID NO: 97 - DNA, 1755 bp, Homo sapiens
cgcccgggcaggtcccaaaattaggggggaagaggaaaaaaaaaagccagaaaaagttttcttttctggagtcccaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcaccacgctggccaaactgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcttctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgtattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaaaaaaaaaaaaaaaaaa

SEQ ID NO: 98 - DNA, 1007 bp, Homo sapiens
gaatacagaatgtgggcaaactcgcttctgtgccggccgccagaaggtttgctgagggcaatcactccctggtgccgggctccttgaggttatgcactgggacatctagagcctattgtttgaggaatgcagtcttgcaagcctgctctggatcaagccacagactgaaacacccccgaagagcaagcacgtttcttggagcaggctaagtgtgagtgtcatatcttcaatgggatgaagcgggtgcagtacctgaacagatacatccataaacgggaggagaacctgcgcttcgacagcaacgtggaggagttccaggcagttacggaactggggcggcctgtcgcagagaactggaacagccagaagggcatcccggaggagaagcgggacaagatggacgactactgcagatacaattacggggttttttgagagcttcacagtgcagccgcgagtccatcctaaggtgactgtgtatcctgcaaagacccagcccctgcatcaccgcaaccccctggtcggctctgtgagtggtttctatccaggcagcattaaagtcaggtggttccagaatggtcaggaagagaaggctgcggtggtctccataggcctgatccagaatggagattggaccttccagaccctggtgatgctggaaacagttcctcggagtggagaggtttacacctgccaagtggagcatccaagcgtgacgagccctctcacagtggaatggagtacacggactgaatctgcacagagcaagatgctgagtggagtcgggggctttgtgctgggcctgctcttccttgggacagggctgttcatctacttcaggaatcagaaaggacactctggacttcagccaacaggactcctgcgctggactcctgagctgaagtgcacatgaccacattcaaggaagaaccttctgccacagctttgcaggatgaaaagctttcccacttggctcttattcttccacaagagctctctcaggacca

SEQ ID NO: 99 - DNA, 1825 bp, Homo sapiens
aaaatccatgttgtttaatagaatgccatcctttacctacttttgctctgtatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgtttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaaaaaaaaaaaaaaaaaaaaaaaaaaaaaa

SEQ ID NO: 100 - DNA, 1387 bp, Homo sapiens
cctcgtgccaagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctggggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtccaaaaaaaaaaaaaaaaaa

SEQ ID NO: 101 - DNA, 2853 bp, Homo sapiens
cggatcatttaggtgacactatagaatacggatccgtcgacggccattaccaatcgcgaaaccgctcgcgcgcgtgcatcccgcaccatcccccggccccgggccctggccggcgtcagaccgagctgccgccgccaccaccgcagcagcagcagtcggggagccaggcccagccagggccgcgggaggcgggggcgcccgggccctggatgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggtgacctgcaaaagacattcgagattgaactgtagtccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgaccacacgctgcgttcactgccaatgctgtactcacctccatcaccctccaactttggggcccatgtcttccttgggccaaggtctcatgggggctagcgccaagttgggggcccaggaggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataaaaaaaaaaaaaaaaaaaaaaaaaaaaaaacaaaaaaa

SEQ ID NO: 102 - DNA, 1642 bp, Homo sapiens
taaaaagcaaaagaattccggggtagttatgggaaagaacctagagagcaagaagaaaagaggaatggtgcccgaatctgggagagatagacttcaggatggccagtcattgaatgggggataggtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctgatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaa

SEQ ID NO: 103 - DNA, 2890 bp, Homo sapiens
gtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatttttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccaccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgtt

SEQ ID NO: 104 - DNA, 762 bp, Homo sapiens
gcagagaccggctagactttactcaatttgaagagaaatttataggatctgcagaagatttgggaaagttaagaaatgatgggagtttgatgttccagcaagtaccaatggttgagattgatgggatgaagttggtacagaccagagcccttctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaaaaagtgttacagagccatggacaagactaccttgttggcaacaagctgagccgggctgacattagcctggtggaacttctctactatgtggaagagcttgactccagccttatctccaacttccctctgctgaaggccctgaaaaccagaatcagcaacctgcccacggtgaagaagtttctacagcctggcagcccaaggaagcctcccgcagatgcaaaagctttagaagaagccagaaagattttcaggttttaataaagcagccatggaggctaagaacatgcaagaccaatattctaaagttttgcaacaatgaagtgctttacttaagtgttgattgtgcctgttgtaaagctaatgaaccctttccaattatatgctaattaaataataaaaactcctatttgct

SEQ ID NO: 105 - DNA, 3200 bp, Homo sapiens
caggaagggccatgaagattaataaagatttggactcagggcaaatatttacttagtagcaataactcaaagaattactgttgaataaataagccaattaagcagccaatcacgtactatgcggatgcacacaaatgaaaccctcacttcaacctgaagacattcgcacatgagttacgtagagggacctgcaggaagcggtagagaaaacataaggcttatgcgtttaatttccacaccaatttcaggatctttgtcactgacagcagcactaagacttgttaactttatatagttaagaagaacaaggctgagcgcgatgactcacgcctgtaagcctagaactttgggaggccaaagcaggcagactgcttgagcccaggagttccagaccagcctgggcaacatggcaacaccccatctctacaaaaaaatacaagaatcagctgggcgtggtgatgtgttcctgtaatctcagctactcgggaggcagaggcaggaggattgcttgaacccgggaggcagaggttgtagttagccgagatctcgccactgcactccagtctggacgacagagtgagactcagtctcaaataaataaataaatacataaatataaggaaaaaaataaagctgctttctcctcttcctcctctttggtctcatctggctctgctccaggcatctgccacaatgtgggtgcttacacctgctgcttttgctgggaagttcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcctttgtgctgccccttgaggaagcaaagagaggattgcttttgcttaaggaagctggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgagtatttggacattctcgctatctcctgtgacagctttgacgaggaagtcaatgtccttattggccgtggccaaggaaagaagaaccatgtggaaaaccttcaaaagctgaggaggtggtgtagggattatagaatccctttcaagataaattctgtcattaatcgtttcaacgtggaagaggacatgacggaacagatcaaagcactaaaccctgtccgctggaaagtgttccagtgcctcttaattgaaggtgagaattgtggagaagatgctctaagagaagcagaaagatttgttattggtgatgaagaatttgaaagattcttggagcgccacaaagaagtgtcctgcttggtgcctgaatctaaccagaagatgaaagactcctaccttattctggatgaatatatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaagaaataagctctagtgatatctgtgggggcaatatttaatttggatttgattttttaaaacaatgtttactgcgatttctatatttccattttgaaactatttcttgttccaggtttgttcatttgacagagtcagtattttttgccaaatatccagataaccagttttcacatctgagacattacaaagtatctgcctcaattatttctgctggttataatgcttttttttttttttgcttttatgccattgcagtcttgtactttttactgtgatgtacagaaatagtcaacagatgtttccaagaacatatgatatgataatcctaccaattttcaagaagtctctagaaagagataacacatggaaagacggcgtggtgcagcccagcccacggtgcctgttccatgaatgctggctacctatgtgtgtggtacctgttgtgtccctttctcttcaaagatccctgagcaaaacaaagatacgctttccatttgatgatggagttgacatggaggcagtgcttgcattgctttgttcgcctatcatctggccacatgaggctgtcaagcaaaagaataggagtgtagttgagtagctggttggccctacatttctgagaagtgacgttacactgggttggcataagatatcctaaaatcacgctggaaccttgggcaaggaagaatgtgagcaagagtagagagagtgcctggatttcatgtcagtgaagccatgtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttaaaaaaaaaaaaaaaaaaaaaaaaaaaaaaaaggcca

SEQ ID NO: 106 - DNA, 1016 bp, Homo sapiens
cctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattag

SEQ ID NO: 107 - DNA, 1799 bp, Homo sapiens
gcttgaaccggggaggtggaggttgcagtgagctgagatcacgccattgtactccagcctgggcgacagagcaagactccatttcaaaaaaaaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctggtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagatacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaaaaa

SEQ ID NO: 108 - DNA, 1672 bp, Homo sapiens
atcacattgaatggttaatttatttttaattctatgaaaggagctggagagagagaagtaaaatattcaggggattttctgtgttttaaaagagaaaacctcctgattgcaagctctaaaataaatgctaagatttgtcacactttcagcccacgggagatttgcttttctcgcatagtatggactcaccaggatctgaaattaggggctttccttagaggtggcctcaggctttcctacccccacagttggattatgcagagaaggtcactgggtcctgaggctgctgccgagcgtgctgtcccgggtggacagcgtgccctgtcatctttcattaggatgtgtgtgcctgtgccgcaccagccacaggtcaggatgccagcccctgcacgccctgcgtgctcatttgaaaactgagggtatctgggaagtcaccttacaaggtgccgaggagcagatggctaatttaaaggcaatctgtatgtgctctgagcctcccaaattatccatttcttgaatcctcaatgtgtgaaattcagcacactaagtcctcacaggctaggaaatcaaatgctggacaggccattccctaccatcatctggagtattcagagtatttggaatattcacagtcttcaaggtgtagctgtcgggctctgtgaaggataccttgcatttatagggatcgtcaggtctcctcttcctacgtatttgaagtattatggcttggagtactttctccaccaatgaagaaaagtttatatggcctctcctacgctcttgtcttgtcccaaaagtagggcttaactctgtccttgccatcaatctgtgcacatgttatggagtgaccatggtgaatgggcgatagaggttccttcctaggagaaactttcccagcttccccaaatgtgagaggggcgcctctctcccgaattccccagagccctttcctcccttccctctgccctcacctccctggatgcttcaggatactctgtggatactcttccgtgctccaggagagcatggccccgtggctgatagactcagctctcacccctctaagagctgctcatgagtatcctcgagtggatgagtgaacagatttctaactcaacagacataaatccccagtggagcttaagttaaatgcctggtttttaaattaagaaatatgacttcagcaatatgtataaaccaaaggaacattaaactaatgatagtatctttacaaatgagttgttgaggatttggagatagtttgtataacataaaacataacaaatacagtagaaagcatatggtagtgggattgaagaaacccgagaggttatttatcccaaacaccacctgatgttacagtgcttattgagtgattgatactgtgtcctacgtagagggggcacataaacaattcacatgtaatttttctgtattacattgacagatatatataaaatgatctctgcatctaaaattcaagcagtccagcctggaatactatcaccaaaaagtgaaaactgattttagaaacgaataatattttgttgtgaacaactctgaaaacatactggtcgatgaggtttatagctagagtctaaaatgccacatttatatgggtgaaacattttcagcttcaggagaaaataaaaccaaaaaaaaaaaaaaaaaa

SEQ ID NO: 109 - DNA, 1527 bp, Homo sapiens
ctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaaaaaaaaaaaaaaaaaa

SEQ ID NO: 110 - DNA, 1585 bp, Homo sapiens
gacatgaaagtcattaacaaagccagccgtgaaaaggtgccccagagttgctgtggacagacctgtaaggacttgcaaaacaaaagaaagtgaggggtttttttaacctcagagctagctgctctctgcagcctcctccactggcttctctggctcacccaagctctcccttacagaggcaacacagaattataaggaatcagaaatcccccttctaccaggctgcaaatgtggctctagcacttgcaaattgttttttcttccgaatagttcagcagggacaagttatctgaggggcaaaatgcctgcttggaggtctgcaattttggaacactgcagtatggaactttggcattggagggtctgtaaaatatttttgttcttttaccaccaacttaggggactgttttaaagagccatcccaaggcctctcctagcaggcagaagccactcctctgataacggcctctgtaaatgttctgatttgctctcagctgcagagacacagagacactgcagatgtcacacgctttcatcttccctttgagcccttttgaaccctcctggggctctggggtagatgagagaagcctgaaaaaggcagagtttgaaagctcccatttaaaaacaaaatactttttaaagccctcttgcctcttccctgcccactcctgccccctgaccagaagacagaatttgaagctggaaagggaagaccccttttcccctcctcctgtccccagtgagtcttagcgagacttttgccctgcgcacaattgcatctgaatgtgcgggggagagggctgggggccggagggcaggcaaggcctggggggtgctcgtgatacgtgctcaagccagttgtgggaaaaactcgagtcctcccctcctcccgacctaccccgtgtggctgcttttggctggattccctgcacccagtgcaacacaccctttccccttcactctcccttggttactatggaaacaagggtgtcattgatgtgggctgagctggggaacatgtcggtgcacagctgaaagtcagcgattatgccggcggttagaaatgtgccagggttaaaggagtccgcagctcccacggctgctgggaggacatggtcctgcccccttccttcctccctccctccgtctccacttctctctccttgcttttgacaaatttctttattcccctctggactaaagtagtggctatttttgtgccactctgcgccccaccctcactgttggccgctccttatccggcctggcctggagggtgacaccatgtcaccctcaccaggactcgtctctccattcccgtcagagtttgctttgatttccctttcctttccttctcggggaccagttcttacttccttttatttttagctctgcactccatgtggtttcagggttcagtctgatccatcaaaaggttctttttttataatcccttttgaaaatgataatcaaaggaagagatgtggtgtttggtcatgtggaaaactcaatgtataatttagacgtctgtcaaaaatccgacaaataaaatttagctggaacgaaaaaaaaaaaaaaaaaa

SEQ ID NO: 111 - DNA, 4693 bp, Homo sapiens
ccgagccctgaggcaggcggcggcggaggagccctcaaggcgagcagcgcgcgcgcggctgccgcgggactgctgcgggaggcgggcagcgggggccgcgagcgggcggactggcggcggcggcagctgcgcaaagtgcggagtgtggagctggaccagctgcctgagcagccgctcttccttgccgcctcaccgccggcctcctcgacttccccgtcgccggagcccgcggacgcagcggggagtgggaccggcttccagcctgtggcggtgccgccgccccacggagccgccagccggcgcggcgcccaccttaccgagtcggtggcggcgccggacagcggcgcctcgagtcccgcagcggccgagcccggggagaagcgggcgcccgccgccgagccgtctcctgcagcggcccccgccggtcgtgagatggagaataaagaaactctcaaagggttgcacaagatggatgatcgtccagaggaacgaatgatcagggagaaactgaaggcaacctgtatgccagcctggaagcacgaatggttggaaaggagaaataggcgagggcctgtggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgccttttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcagaactgcagctgtgcacatggaacattctgtattcatctgctatttgtgatgctccgggtgtttcaactagaaccttcagacccaatgttatggagaaaaactttaaagaattttgaggttgagagtttgttccagaaatatcacagtaggcgtagctcaaggatcaaagctccatctcgtaacaccatccagaagtttgtttcacgcatgtcaaattctcatacattgtcatcatctagtacttctacatctagttcagaaaacagcataaaggatgaagaggaacagatgtgtcctatttgcttgttgggcatgcttgatgaagaaagtcttacagtgtgtgaagacggctgcaggaacaagctgcaccaccactgcatgtcaatttgggcagaagagtgtagaagaaatagagaacctttaatatgtcccctttgtagatctaagtggagatctcatgatttctacagccacgagttgtcaagtcctgtggattccccttcttccctcagagctgcacagcagcaaaccgtacagcagcagcctttggctggatcacgaaggaatcaagagagcaattttaaccttactcattatggaactcagcaaatccctcctgcttacaaagatttagctgagccatggattcaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttaaaaacattgagagccatgctggtatatactccttgccacagtttagcggaaagaatcaaacttcagagacttctccagccagttgtagacaccatcctagtcaaatgtgcagatgccaatagccgcacaagtcagctgtccatatcaacactgttggaactgtgcaaaggccaagcaggagagttggcagttggcagagaaatactaaaagctggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagtgtttccactcacttcaccaggatgcgtcgccgtttgatggcttatgcagatgaggtggaaattgccgaagccatccagttgggcgtagaagacactttacaacgacaacaacacaacagcttttgcaggcatctgttcccaacaactatctggaaaccacagagaacagttccccttgagtgcacagtccatttagagaaaactggaaaaggattatgtgctacaaaattgagtgccagttcagaggacatttctgagagactggccaggatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctcgacctaccccaggtaatacaagtaaacagggagatccctcaaaaaatagcatgacacttgatctgaacagtagttccaaatgtgatgacagctttggcttgagcagcaatagtagtaattgctgttataccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggtagccctccccatagttcctcagctgcaggttgaaaatggagaagatatcatcattattcaacaggatacaccagagactctaccaggacataccaaagcaaaacaaccgtatagagaagacactgaatggctgaaaggtcaacagataggccttggagcattttcttcttgttatcaggctcaagatgtgggaactggaactttaatggctgttaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcagggggatcggtggctcatttgctgagtaaatatggagccttcaaagaatcagtagttattaactacactgaacagttactccgtggactttcgtatctccatgaaaaccaaatcattcacagagatgtcaaaggtgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgctattatagaaatggcttgtgcaaaaccaccatggaatgcagaaaaacactccaatcatcttgctttgatatttaagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatacagatcaactacgtagaaacaggatgctcaacaagagaaaaaaaacttgtggggaaccacattgatatctacggccatgatgccactgaacagctatgaacgaggccagtggggaacccttacctaagtatgtgattgacaaatcatgatctgtacctaagctcagtatgcaaaagcccaaactagtgcagaaact

SEQ ID NO: 112 - DNA, 1281 bp, Homo sapiens
gaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccatggctgtgaagcttcatggaggtatcgatatcctagtctccaatgctgctgtcaaccctttctttggaagcctaatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgtaaatgaggtgcaaataaaatgcagatgattgcgcggctttgaaaaaaaaaaaaaaaaaa

SEQ ID NO: 113 - DNA, 753 bp, Homo sapiens
taccgagctcggatccactagtaacggccgccagtgtgctggaattcgcccttactcactatagggctcgagcggccgcccgggcaggtggattgttggtctgcgtggaacttctcaggtggacaccagagcatggaacacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgctttcttaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggacgtgccgggtttatcattgctttgttatttgtaaggactgaaatgtacaaaacccttcaat

SEQ ID NO: 114 - DNA, 993 bp, Homo sapiens
gggcgccggggccgcggccgggccggctccagggccggccgccgcggtggggcgcaggccgccgcgcgagtgaatcgaggcggcgggcccatccggaaccggccggccatcgcccgcggcgcggccggcggaggcggcaggaaccgaccggcgccctacagcaggccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcaaacgtgcactttgagcggaaggcagatgccctgaaggccatgaagcagtacaacggcttccctctggatggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcgcccaatgatggatttgtttcttttatgttttaaaataggatttaaaaactcatgtaaaggttttttttttttcttttttttttttttaattctgaaacagacctgttttgtaccgagttatttttgggataaattttactggttgctgttgtggagaaggtggcgtttccaccggaattccaaaaaaaaaaaaaaaaaaaaaaaaaa

SEQ ID NO: 115 - DNA, 1445 bp, Homo sapiens
ggcacgaggcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacacttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattagggctttttaccatcaaaatttttaaaagtgctaatgtgtattcgaacccaatggtagtcttaaagagttttgtgccctggctctatggcggggaaagccctagtctatggagttttctgatttcccctggagtaaatactccatggttattttaagctacctacatgctgtcattgaacagagatgtggggagaaatgtaaacaatcagctcacaggcatcaatacaaccagatttgaagtaaaataatttaggaagatattaaaagtagatgagaggacacaagatgtagtcgatccttatgcgattatatcattatttacttaggaaagagtaaaaataccaaacgagaaaatttaaaggagcaaaaatttgcaagtcaaatagaaatgtacaaatcgagataacatttacatttctatcatattgacatgaaaattgaaaatgtatagtcagagaaattttcatgaattattccatgaagtattgttt

SEQ ID NO: 116 - DNA, 2329 bp, Homo sapiens
gcaggggccgagtctctcggaagccctcgtgaggactcggacctattcggactgattcggcttcccacttcggggaacttcgaccctcctcggttcaggactcggtctcggctcggcggcttcgtgcaggttcggctcctactcgggcagcctctgttcgcctcggctccgctccgcgggcggactcggctcggctctgctcggcggctggctgccttttcggtccctattcgggcggcggcttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgacgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtctggcccacagggcctgtgctgcgacgcacatacatacgtgttgtgtctgtcaataaagtgtaaataaggtc

SEQ ID NO: 117 - DNA, 1230 bp, Homo sapiens
cgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaa

SEQ ID NO: 118 - DNA, 1622 bp, Homo sapiens
attagtcatagcctggctttatagaatccaggaggtccttttagctgaaacaagtggcttcaaaagggaacatgaaacagtgaaaagatagccaaaggtcagtgaaaccacagcatttctttctaatctggctgaggccatgggggggaatgaggggaaaatatgcttccgggccaaggtcaccgagggggaccttgggatttgtgtcctccccagtgcttagagtagagatacctgcaaattcatggcaaacagttggaagaattacttgactgaaacaacccaatcttactttctttcgtaagttgaacctctgatttattgtggggttcaggctctcctcaatagaaggccagagttggacaggtggactaaggtcaaggatgaggagtctgcagtggggactaccacagcaaactgccttccttccgtggagtcctaactcagccatgtggtccactcacccaggggcccgggggctcagacaaaccccatggggaacatgctgccatgctctgtctttcttgtaaacgtagttgggtagggatcccaagggtatttgctctctccaaatgcagaacttccatccactttatctggtgatctgatgaacagcatggggacgtggaggtgaaataagcatctttcagaataaggtttttttttttttcctcttccagaaccaaaggctttagacatttgtagaactttctggattccttctgaatcgggttttaacataaaaaaccatcaacacatcatgggaaaggagctctttcatgatatacatcacatgtttcttgctctcattgaggaaatgtgttgtacaaaagcaccaaataagggcaccctggaagtgacatgtgtgtttcttctaagtcgtttttagtgcatcccctgcgattgcatgatgctcatgtggcttttagggaaaggcagaatgtgctagaagtcgaagtcattcaatattcagtgcttactgttactttgaaccaggtaatctcagttctttattcagtccttcccaaagaccttacaaaggagatgtgtaaactgatagattttgagcctaataagtcacagaaatggaaaattttagagcagtttgtttcacttaggtgagaactgattactttaaattaccaacatgtgcaaattctacttagtattcattattagatgctaagctggaaaagatgagaaacccaaggagaactattgaattaccacataattgtaatattatgctttaattttgtatgggcagtgttctatcagactaagcttctagcctttgaaatgatttacatgaggagagagcctgtatatctgacttgggaaacattaagcagaccctattttcactggcgcggtaataactatttatttgctatcctagaggtgctgggaatgagcctacgtgcgactttgatgagatatattcacatttggtgttggaacgaccacatagcaaagtgttggtttttttttattgtaacactctgtgtaaacgttgacaccttattaaatattaaatgtctgaactctatttttaaaaataaaacaagcacagagtctgcaacaaacatgttaaaaaaaaaaaaaaaaaaaaaaaaaaaaaa

SEQ ID NO: 119 - DNA, 1484 bp, Homo sapiens
tggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataaaaaaaaaaaaaaaaaaa

SEQ ID NO: 120 - DNA, 1316 bp, Homo sapiens
aaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtacgcagtagtgcttttgtcagcacagactgctaatctacatcttgctgcgttctgtttgctgaggttgggcttattcatttaacacgtaccaaccattatccagaggcaccatggagagttagtcatggaataaagcactgtccttgcagatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttgaaaaaaaaaaaaaaaaaaaaaaaaaaaaaaaaaaaaaaa

SEQ ID NO: 121 - DNA, 1380 bp, Homo sapiens
gtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgcagccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggaaaaaaaaaaaaaaaaaaaaaaaaaaaaaaaaaaaa

SEQ ID NO: 122 - DNA, 1325 bp, Homo sapiens
gaaaaaaaatgaactattttgtagcattgaacaagggtaggttccttgaatagtgccttgaaaatcatttacttaaatgctatcattttatggatactgaaagtgtgacatcagtgcccaagattacatggcttaaacttagagggtagggtgggacccagaatcctgacttgtgaatctcccttgctagagttttctgcctcatgccagagcctcctcctgcacagggatttctcacgccctccccaccctgcagcttcaatagggattttccctggacatactggctgctcttctccatagtaggcatttttccatgaagcaagtgtcattatgcccatgcacagatgaagaaactgaagccatgcatatggaggaagcaaaccaatacacatccaaagcaatgcacatccaatgacatggatgatccaaagccactcagctgtaactgctggagctgagacttgagcccagtgctcctaacccctgcattagtgccattctactgatgccaggttgaaaagaagctgtacacatgcagaagacacttttgggagcctttgcaatagcagatgttttatagctgagcagatcaagctgggaagaaatggtcgcttttcatagccatctctctgcacttgttggccttccctgacagtagcaacgttcttcattcttagatccctttcatcactaaggggatgccactaaactgaatttcttagcatggaaatgttacattccagggattgattttcctgcatagtatttctagaaaagttaatcgcctcattagtcatatttacattttattttaattgcatcctcgagagcaaatgtattcatttttttcctatgttatagttctctctttaacaaccccttaataaagcagagacaagatcagagcacatgaagagcactttgctttcttaaaatatgccacctcccaaaaatgtagggcccaattatcactgcggctataagctaattatcagatacaaaatatggatcacaactaattatcagaatctgaccttatttccaagtcatagattcctataaactaggttaacattagagatttaagcaggaactcaagaactgcagtaacccatggaaatgaatgtttatatttctaacaaatggctaaggcaagagatgattttctgaggcttatgtctggtgaaattttccagaagttcacgctctgcaaggccttattagtagaacatggatgatgaacggtccatttcattagtaacctgaaaccttctatttggagataaagatgactgcttccatttaaaaaaaaaaaaaaaaaa

SEQ ID NO: 123 - DNA, 1320 bp, Homo sapiens
ggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctgaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgcctgacagtggagcaggccgtgctgctgtcacgcctggaggaggagtaccagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctggaaaaaaaaaaaaaaaaaaaaaa

SEQ ID NO: 124 - DNA, 1722 bp, Homo sapiens
ggggaaaagagctaggaaagagctgcaaagcagtgtgggctttttccctttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaaaaaaaaaaaaaaaaaaa

SEQ ID NO: 125 - DNA, 6503 bp, Homo sapiens
attactgtatatgtatgtattcagccgtgattcccaaaggttcattttatgacagcatctttctgatttcctcacagtttattatcttcccattgcccaagtttagtaactttatattagttttggcttcgtacaggcaccactcattgggagcaacacagaaatctgtttcaaaacatcatttcaggaaaaagagaatattttagcgttgaggatctttaaaagtattgcagtactttatagaactaagttgtaggagctaagaggatcttttaattcatgctatgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggggaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctgatggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatctaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtgattgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatct

SEQ ID NO: 126 - DNA, 1341 bp, Homo sapiens
ccacgcgtccgggcgggtgaaggtgtgtgtcagcttttgcgtcactcgagccctgggcgctgcttgctaaagagccgagcacgcggtctgtcatcatgtcgcgttacgggcggtacggaggagaaacccaagatgtatgttggtaacctgggaactggcgctggcaaaggagagttagaaagggcttcagttattattgtcttagactggatgattgaagggacattatgcttatattgtcaatcgttcagccggcgaagaagaagcaggtcacggtctagatcacatctcgatccagaggaaggcgatctctcgctcacgcagcaggagcaggggacgaaggtcaaggtcagcatctctcgacgatcaagatctatctctcttcgtagatcaagatcagcttcactcagaagatctaggtctggttctataaggatcgaggtattcaacccgtcgaggtcaagatcaagatccagctattacgaccaagaagcagccgatcaagtccagactcattcaagagtgtccatagagtctcgatgcttccgcgcgttgggagctctcccatatggactagtgattagtcagccacgccaggggatgaaggactgctacaaggagtgtgaagaggaatggggaccacgggaagctggtggggtcctcacccatctgtggtttttagtccgatggaacagatactatcccatccacagaaagcctttatctactaggagactaagaaaaagaaaaatactcagacttgctaggaccacaggtgtgggtgtttgttgggaaaaagtattgggaagatcggggtccatagggcgaggcgtctctgatcccctttgaggtttaactttctgcttttgatttcctgttagcatttggcctcctacagtggctgactaataaaagggttccggggttttttcccaatccccgtcgaggtcaagctccaagatccaggtctatttccacgacccaagaagccagccgatcaaagtcccagattctcatctccaaaaagaagtcgttccccatcaggaagtcctcgcagaagtgcaagtcctgaaagaatggactgaagctctcaagttcaccctttagggaaaagttattttgtttcacattattataagggatttgtgatgtctgtaaagtgtacacctaggaaagataattcaaccatctaatcaaaatggatctggattactatgtaaattcacagcagtaagataatataaataaagttgaatgtattaacatcatatggtctgaaaatgtgggtttttatttggcacatttaaataaaatgtttctaactagaaaaaaaaaaaaaaa

SEQ ID NO: 127 - DNA, 325 bp, Homo sapiens
tcctatgagctgacagccaccctcggtgtcagtgtccccaggacagacggccaggatcacctgctctgcagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttcccatgtggtattcggcggagggaccaagctgaccgtccta

SEQ ID NO: 128 - DNA, 2139 bp, Homo sapiens
cctggtcagcgtcccatcccggtcgggagttctctccaggcggcacgatgccgaggaaacagtgaccctgagcgaagccaagccgggcggcaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaagaatcaaaaatgtccaaaatgtaactggagagaaagtgggcaacttttgggagtgacttttccacaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggtccacgagaacagtctccactggcacggcattgtctcactataggaggagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatcctaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccccaaaaaaaaaaaaaaaaaaaaaaa

SEQ ID NO: 129 - DNA, 333 bp, Homo sapiens
aattttatgctgactcagccgcactctgtgtcggggtctccggggacgacggtaaccatctcctgcacccgcagcagtggcagcattgacagcaactatgtgcagtggtaccactagcgcccgggcagtgcccccaccactgtggtctatgaggataaccagagaccctctggggtccctgatcggttctctggctccatcgacagctcctccaactctgcctccctcaccatctctgaactgaagactgaggacgaggctgactactactgtcagtcttatgatagcacctatcatgtgatattcggcggagggaccaagctgaccgtccta

SEQ ID NO: 130 - DNA, 1384 bp, Homo sapiens
ccagctcagcctctgtgcccaccctagctagcaccctgggtgaagcccctgccccacccccactgtcagtgcgagtcctgggcagctcctccttgcagctgctgtgggagccttggccccggctggcccagcacgagggcggcttcaagctgttttaccgcccagcaagcaagacctccttcaccggccccatcctgctgcctggaaccgtctcctcctacaacctcagccagctcgaccccactgcagtgtatgaggtgaagctgctcgcctacagccagcatggagatggcaatgccacagtccgctttgtgtctttgaggggagcatctgagaggacagccttgagcccaccatgtgactgccggaaggaggaggccgccaaccagacgtccaccacaggcatcgtcatcggcatccacatcggggtcgcttgcatcatcctctgtgtcctcttcctcctgttcggccaaaggggcagggtcctcctgtgtaaagatgtggaaaaccagctgtcccctccacagggtccccggagccagagggaccctggcattctggccctaaatggggcgagacggggacagcggggccagctgggccgagacgagaaacgtgtggatatgaaggagctggagcagctgttccccccggccagcgcagcagggcggccggaccccagacccacacaggatcctgcagcccccgctccgtgtgaggagacccagctctccttgctgccacttcaggggtgcggcctgatggaggggaagacgacggaggcgaagaccacagaggccacggctccctgcgccggcctggcggctgccccaccacccccagatggaggccctggcctcctcagtgaaggccaggcttccaggcctgcagcggcccgggttacccagccagctcactcggaacagtagccagtgtctggcaggctccagagggtggacggagcggggcccattctcaggtcaaaagcaagatttctactgtcatgtgggatttgaatggtcctgggggctccccagtatttctatcctgactgcctcttgggttgtcaaaacccaaggcagccttgacagggaccccccggccctaacacccatcaggagttggagcagttcctgcaggagcctgttccttccctgggctgacgcccccttgcctctgcctggtacccacatgacttggaactgaactaacatttttctttaaaaagcaaaacttaaaaaaaaaaaagaggagagagatagaggaaggtgaattagactccaaaagatgaccctgctgtagctgggccctgacactgtcaccctccaccgactttgttttctcaggatggatttttgctgttttggctctcagcacctacctc

SEQ ID NO: 131 - DNA, 255 bp, Homo sapiens
gtgaagcagatcgagagcaagactgcttttcaggaagccttggacgctgcaggtgataaacttgtagtagttgacttctcagccacgtggtgtgggccttgcaaaatgatcaagcctttctttcatgatgttgcttcagagtgtgaagtcaaatgcatgccaacattccagttttttaagaagggacaaaaggtgggtgaattttctggagccaataaggaaaagcttgaagccaccattaatgaattagtctag

SEQ ID NO: 132 - DNA, 3005 bp, Homo sapiens
gccgcggcaccagggcgcgcagccgggccggcccgaccccaccggccatacggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggcaaagaacagaaggagaccaacatcgaatccatgaaaatggagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagtt

SEQ ID NO: 133 - DNA, 1452 bp, Homo sapiens
cactttcttgctcctgcctccctacctggcacccaggccggccctggtaccctggtactgaataaaggcacacgtctaaatgatgtcggggggaatctgcccagtgttggcactggagcgaacacgacccactgccagcatggcccacgagccacacccccccaagccagcacctcctccccagaggaagcacggggctcgacggggcacgcccctgaatgggaggtcacacatggtgagggctcccttgttcccagaggtctagctgtctccctgctaagatgcagagctcactatgggcctcgcagggggttaagccgagtcatttcatcttcacagcagctgtaggtcccgctgacatagctgacacatagagagctaaagtgacctgtgcaaggtcacaggctaggagtagcagcacggggcccagcacgaggaacagccttagcatcccccgcctccccaaccctgcagcctgccctgactccaatcccaggggaattcctgagctgcaggcaaaggctgaagcaggagctgacaagccctgctgagcccagagaggtctgggcggtcccaggagggcgtctccctagggctttgatgagttggtggccgcccaggcacctctgcctgcctgcccagcatggcaggtgtgtgggctggagcttctgcccagccctgccccacagccacaattaggggacgagtgcagataaagcacgggggccagttacatctgaatttcagataaacaatgaattgttattttagtacagtatgaaagtatttggccccaaagaactggaagcaggaaaaggaacagctcctcatacacccatgctcacagcattattcaccagagccggaaggtagaaacgatgtctctccacagtcgaatagattgtttccacaaactgtctgtaggtgcatacaatggaataggattaatccgtgaaaaggaagaaattctgacacatgctccggcgtggaggaaccttgaggacgacgctgagtgaaagaagccagacacgaaaggacagatacggcaagactcgacttatgtgaggtccctagaggagtcggattcatagagactggaagaattcgcgggccgcaggggcggtggagaggggaaatggggagttactgtttaatggggacagagtttcagttttacaagatgaaaagggtcctggagctggatgggggtgacggccgcacaacagcatgaatggactgaacgccactgaaaactgaactcttgaaaatggttaaactggcatattttgttatgcatattttgccacaaaaagcaaacaactcttctccccaaaaatatctggggtgtacttacactaaatatgtagggcatatttactctcaacatttatttccttatttgaaattaaagtatttgggacacactgcactacaaaaaaaaaaaaaaaaaaa

SEQ ID NO: 134 - DNA, 1492 bp, Homo sapiens
agagtccgggcgctgaaggccagtgcccaggatgctggggagtcctgcaccccagaggccgagggccgccctgaggagccatgtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagcgcaatgttggccagatcaaaaccgtgtacccggcctcctaccgcttccgccaggagcgcagtgtccccaccttcaaggatggcgccaggaggtcagattaccagctcaccatcgagccactgctggagcaggagctgacggagcagccccccagctcacggcctcgcgcctcctgcagcgacggcagatcttcagccagaagctggtggagcacgtcaaggagcaccacaagccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggggaaatggagaagcacctgctgctcctctccgagctgctgccggactggctcagcctccaccgcatccgcaccgacacctacgtcaagctggacaaggccgcggacctggcccacatcactgcacgcctggcccaccagacacgtgctgaggaggggctgtgagcctgggggccactgtggacagacgtgggcttcagaagctcgctggcctgggcccaccagcattttcttttatgaacatgatacactttggtcttcctttccccagcgcccctgagggccagaggcagatgtgggctgcaggctgcacagcccgagggtctctggctgcgggcggtgggccccttcatggggctcacctggtggattcacattaaaccggtttctgtgggcaaaaaaaaaaaaaaaaaaaaaaaaaaa

SEQ ID NO: 135 - DNA, 1326 bp, Homo sapiens
gtcttaatgatgacaaattaaagatgttttttcagtgctcaggtatgcatatattttcgtgttacttaagcaaaatcaactatataggaggaaaaatcaaaatggcattttattcagctaccagatggcttaaaatgagtaaaccccaacaacatcaagcacatttgtctgtgatattgaccctttttatccaatcattactattttagaagtagtggtgaactgtgtaaaataatggtatcttcagcagtgttccggaatcttagttgagggacaaacattccttccagtgagagattcaagaattgatgtgaattgaatatatttttcaaggtattataaattgtgttgtgttttcagtataagaaaatgttgacaggaaacaattttatagcatttataaaaaaccaacacttgtgcaatgctaaattggcgaagcttctgcacctgaattagagcacaataaatatgctgtttataaaccaaatcactgctattccttctctgaaatcatctctcctctttttaaacctttacttatagctagaataaatcactatttaattgcctctaatactttaaaactactggatggttaggcctggtttaactatttatggagagctatttgcaaacttaagttgtgtaaatgtaatttctacttgtgaatctgagctgtagcagcccagagggagctaggcaaactattccagaccaccaactgataagtgatcagattctttgtaatgtaggattttttaacctgttgattatgggtttgttgatataaatgtaataatgttcacctcgattttcctggagtaacaaccagcgttggtagtagcccacctgcatgaggacggccagtgttaacaatatttttgttctgatcttcttccccatttttgtttcctcaaacaggtttttaggagagtggagatttaaagtcaggatgtggcctttttattttaattatatacttaattcttagaacaagtagaatgggaaaggagtgactgataaatctaagattcaaaatagtcccgtcgaaacttaaaggccagattattgctttggagctttctataggtactagccatcccgtcgttaaatgttttcatggatatttgaaaagaagaccatgtacctttaataactgttcttttctcgagtttctgcctcgtgctttgacctggattgcattattattgtttatgcgaagtaaaaaaaaaaaaggaaagcacaagcttttcctgtatattatatttccatttccattttaaaataaaaacaattttccccaccaaaaaaaaaaaaaaaaaaaaa

SEQ ID NO: 136 - DNA, 2711 bp, Homo sapiens
taggcggagcgggctgagcagcccgggcgcgatgcgttgagcgctcggagggccaaccgccggtccccttggcggcaaccggcggcacccatggaaccactgggcaactggaggagcctgcgggcgccactgcctccgatgctgttgctgctgctcctgcaggtggcggggcccgtgggcgccctggcggagaccttgctgaacgcgccgagggccatgggcaccagttccagcccgcctagccctgcgagcgtggtggctcccggaacgacgctgttcgaggagagccggctgcctgtgtttacgctggattacccccacgtgcagatccccttcgagatcaccctttggatcctgctggcctccctggccaagattggcttccatctgtatcacaagttgcccacaatagtgcctgagagctgccttcttataatggttggacttctactaggtgggattatttttggtgttgatgagaagtctccccctgcaatgaagactgatgtatttttcttgtacctcctcccacccatcgtgctggatgccggctatttcatgcccactcgcccattctttgagaacattggcacgattttctggtatgctgtggtagggacactttggaattccattggcattggggtgtctttgtttggtatctgccagatcgaagcattcggcctcagcgacatcactttgctccagaacctgctctttggcagcttaatctcagctgtcgatcctgtggctgtgcttgctgtctttgagaacattcacgtcaatgagcagctctacatcctggtctttggagagtccctgctgaatgatgcagtaacagtggtcctgtacaacttgttcaagtcgttttgccagatgaaaaccattgagaccattgatgtgtttgcaggaatcgccaacttctttgttgtgggaatcggtggggtgctgattggcatcttcttgggctttatagcggcatttactactcgattcacccataatatccgagtgatcgagccactgtttgttttcctgtacagttatttgtcctacatcacagctgaaatgtttcacctctcaggcatcatggcaatcactgcttgtgcaatgactatgaataagtacgtagaagaaaatgtatctcagaaatcctacacgaccatcaagtacttcatgaagatgctgagcagtgtcagcgaaaccttgatcttcatcttcatgggtgtgtctaccgtgggcaagaaccacgagtggaactgggccttcgtctgcttcaccctggccttctgcctcatgtggcgagccctgggtgtttttgtcctgactcaggtcattaataggttccggaccattcccctgacctttaaggaccagttcatcattgcctatggaggacttcgaggtgccatctgttttgcgttagtgtttctccttcctgctgctgtgtttcctcggaaaaaattgtttattacggctgccattgttgtcatattctttactgtcttcattctgggaataactattcgaccactggtggagtttcttgatgtcaagaggtccaataagaaacaacaagctgtcagtgaagaaatctattgtcggttgtttgatcatgtgaagactggaattgaagatgtttgtggacattggggtcacaacttttggagagacaagtttaagaagtttgatgataaatatctgcggaagcttttgattcgggaaaaccaaccaaagtcaagtattgtatctttatataaaaagcttgaaataaaacatgccattgagatggcagagactgggatgataagtactgtccctacatttgcatctctaaatgattgtcgtgaagaaaaaataaggaaggtcacgtccagtgaaactgatgaaattcgagaactcttatcaagaaatctctatcaaatccgtcagcgaactttatcctacaacagacacagtctgacagccgacacaagtgagagacaagccaaggagattctgattcgccggcgacacagtttgcgagaaagcattaggaaggacagcagcttgaatcgagaacacagggcttccacttcaacctcccgatatttatccttacctaaaaatacgaagcttccagaaaagctacaaaagaggaggactatttctattgcagatggcaatagcagcgactcagacgcagatgccgggaccaccgtgctcaatttgcagcccagagccaggcgcttcttgccagaacagttctccaagaaatccccccagtcctataaaatggaatggaagaatgaggtagatgttgattctggccgagatatgcccagcacccccccaacaccccacagcagagaaaagggcacccagacgtcaggcttactacagcagccccttctctctaaagaccagtctggctcagagagggaagacagtttgactgaaggcatcccgcccaagccgccaccacggctggtctggagggcatcggaacctggaagccggaaagcccgatttgggagtgagaagccttaagagaagcagcgaaagcagatctgagtgtctgacccaggacagctgtggtttgtcactctgaaacctgatgcaacagtggaatccatgtaaaactctctgtgcatctaaatacttctggagggcgacagattcatgccacggataaatgaggcaaatccgaagaaaaaaaaaaaaaaaaaaaa

SEQ ID NO: 137 - DNA, 1912 bp, Homo sapiens
ccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaatttttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcaaaaaaaaaaaaaaaaaaaaaaa

SEQ ID NO: 138 - DNA, 3152 bp, Homo sapiens
ggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaactggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaagggtccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacaggtttgttgtggcctgttcagcctggaaatcctgtcccgagactgatgcggaaaagctagttcagctgactttttgtgcttttcatgatatgatacagctgatgaactctactcatctttagagatgaatcatctattaagcacttaccaaaacatatcattaaactgagtgctgggagtgagttggtaatatgagatgggaaggaatgttgacttgctaacattcctttaacaagttaagaaaacttgttaaatgtagaaattagtagaatcatgctctctaaatttattctgccatagaaggtagaaatatttttaagctcctctgatgcagcagcaatgcaaattatgacatagtgaatatagaactatgcagtatttaagcctcaacaatccaaatctacaaactttaacaatgcaagtcttactctaatttttaagtatttttgttggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatcggttgagcccaggaggttgtggctgcagtgagctgtgatgtgcccttatgctatagcctgggcaagagcgtgagaccctgtctcaaagaagaaaaaaagagaaaaataactcttttgaacaaacagacaaattagctagtagtatggagatgtataccctctattacacacataaaaccgtaacaaaattcattgtggtgtattataattagttttgtgaatagaaaaataaagcacttatgtttaaatttgttacagtgacttttaaaggattaatgttgaatcacattgtcagaattttttcctcctcgctgttcaattttgtagtttttactctcaaaaaatgaaattctcaaaattatatagctttttgttttgtttgaataaatgattcattcctgtttaaaaaaaaaaaaaaaaaaaaaaaaaaa

SEQ ID NO: 139 - DNA, 2832 bp, Homo sapiens
caagtggctgcgggacactgctgccagacctgcccccaggagcgcagcagttcggagcggcagccgagcggcctgtccttcgagtatccgcgggacccggagcatcgcagttatagcgaccgcggggagccaggagctgaggagcgggcccgtggtgacggccacacggacttcgtggcgctgctgacagggccgaggtcgcaggcggtggcacgagcccgagcctcgctgctgcgctctagcctccgcttctctatctcctacaggcggctggaccgccctaccaggatccgcttctcagaccccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggccgtgggtatctgccctgggctgggtgcccgaggggctcatatgctgctgcagaatgagctcttcctgaatgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgctgatcaccaccaagggtagccccagaggggagctccgagggcaggtgcacatagccaaccaatgtgaggttggcggactgcgcctggaggcggccggggccgagggggtgcgggcgctgggggctccggatccagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccgtttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtcaaaaaaaaaaaaaaaaaaa

SEQ ID NO: 140 - DNA, 2844 bp, Homo sapiens
cttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagataattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatccccacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctaccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacaagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaagacataaaataagcgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaaa

SEQ ID NO: 141 - DNA, 318 bp, Homo sapiens
tcctatgagctgactcagccaccctcagtgtccgtgtccccaggacagacagccagcatcacctgctctggagataaattgggggataaatatgtttgctggtatcagcagaagccaggccagtcccctctattggtcatctatcaagataccaagcggccctcagggatccctgagcgattctctggctccagctctgagaacacagccactctgaccatcagcgggacccaggctatggatgaggctgactattactgtcaggcgtgggacaccaacactgcgatattcggcggagggaccaagctgacgtcctag

SEQ ID NO: 142 - DNA, 1402 bp, Homo sapiens
cggagtgggcacatggattgggcacaaagtactcagtagtccaagaatatttcagtaagactgcaagaagggaggaaatcaagtttcaggagaaattctaaaggcctaagactgtcatggatccaaatgtgtattttctgaatttaacatgcaaatctttgttaaggggttcaagaaagtcatttcttattttacaaatactagccatggtaaactgattaggaatatgtttaaaaacaaaaaaacaaaaaactagccataagaaactacttagttctatatcatccctgtgagaaaggaaaaaaaattcttatgttagagaaaacaaagtctaaattctttagatttttcatatatgtttaagcatgtgtgaataacataaaataagccaagcaaaacagagaaatcatagttatgcactgtaccaaattagctcccaaaagaaagtataaactggggtttaagtcaaaggaaaaggggaataaaaactatatgatcatgaccgaagaatcagtgtcatgattttattaagctcataattttaaaattagctcattttataatttcctataattgaataatgttctctaagtgtaaacagtattaaaggcatgattcatctgacagcaaactataatgaagtttacattttaatccaaaaacatttccaagaatattggcatctaatactttttaatagtggtccacatacaaatgttattttgttgaactttcattcaaataaattatattttgccacatacagttattaaaacaaagcagtattttttataaagcatatatgtgtttattttattttttttgaaacagtcagtggtgtgagtttgtctgaggtctttaagaaaagatcttcagccgggcgcagtggctcacacctgtaatcccagcactttgggaggccaaggtgggtggatcatgaggtcaggagttcgagaccagcctggccaacatagtgaaaccctgtctccactaaaaatacaaaaattagtcaggcatggtggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaaaaaaaaaaaaaaaag

SEQ ID NO: 143 - DNA, 2795 bp, Homo sapiens
cggggacatgaggtggatactgttcattggggcccttattgggtccagcatctgtggccgagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcgtatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcggtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcattcacatctagccaagccagtgacctttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgttttttttttttgaggcagagttttgctcttgttgcccaggctggagtgtgatgggctcgatcttggctcaccacaacctctgcctcctgggttcaagcaattctcctgcctcagcctcttgagtagcttggtttataggcgcatgccaccatgcctggctaattttgtgtttttagtagagacagggtttctccatgttggtcaggctggtctcaaactcccaacctcaggtgatctgccctccttggcctcccagagtgctgggattacagggggagccactgtgccggtcccgtcccctccttttttaggcctgaatacaaagtagaagatcactttccttcactgtgctgagaatttctagatactacagttcttactcctctcttccctttgttattcagtgtgaccaggatgggcgggaggggatctgtgtcactgtaggtactgtgcccaggaaggctgggtgaagtccccatctaaattgcaggatggcgaaattatccccatctgtcctaatgggcttccctcctctttgccttttgaactcacttcaaagatgtaggcctcatcttacaggtcctaaatcactcatctggcctggataatctcactgccctggcacattcccatttgtgctggggtatcctgtgtttccttgtcctggtttgtgtgtgtgtgtgtgtgtgtgtgtgtgtgtgtgtgtgtttgtgtgtgtgtgtctgtctattttgatccggcccaagttcctaagtagagcaagaattcatcaaccagctgcctttgtttcatttcacctcagcacgtaccatcgtcctttggggggttgtttgtttttgttttttgctttaaccaaaatgtttgtaaatcttaacctcctgcctaggatttgtacagcatttggtgtgtgcttataagccaataaatattcaatgtgagttccaaaaaaaaaaaaaaaaaaaaaaaaaaaaaa

SEQ ID NO: 144 - DNA, 484 bp, Homo sapiens
ccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaa

SEQ ID NO: 145 - DNA, 2032 bp, Homo sapiens
tttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggagttcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcttgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatgaaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaagtaagtatttagaaatttctgttcaaaatttcaggctttttctccacacttgtatgccaatgtagagaagatcatttatatttgcagtgccatccttaagtcatttttaacatttactgttttcagagttaaagttattcttttttattccaataatttttgtttttcctaagtaccttggtgacaagtcatttcttgtttttatacaaattatgtagtgcttgttgaacttaaaatatatctaaattttataaaatttgagactgagctcttagtgaagtatattctggttttaagtgcttttcgtatgacttggaacatctgcttattttctaatccgctgttttagggtagacactgacaacgttatgtgtggtctttaacctgttgtcatgttttttccctagatgtacaacactgactcatcataaatgtggtgctgctattcgacaaaccagttttagcagggatagcagcattcttatagctgtttgtgatgatgccagtatttggcgctgggatcgacttcgataaaatactttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttg

SEQ ID NO: 146 - DNA, 3075 bp, Homo sapiens
ggcactgtagcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgaccccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccattgtcaacctgcctgggtgcagcgccaaggagctggccccagctgtctcagtgctccagctcttctgcagctcccccaaggccgccctccgttacgccgccgtccgcaccctcaacaaggtggccatgaagcacccgtccgctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgactttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaaaaaaaaaaaaaaaaaaaaaaaaaaaa

SEQ ID NO: 147 - DNA, 3443 bp, Homo sapiens
gagcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagattttaccatttgtattactgcttcccattgagtaatcatactcaaatgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtccttatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtatggaaagggtgttggcactggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttgaaaagtgctatactaagggaaagaattgaggaattaactgcatacgttttggtgttgcttttcaaatgtttgaaaataaaaaaatgttaagaaatgggtttcttgccttaaccagtctctcaagtgatgagacagtgaagtaaaattgagtgcactaaacgaataagattctgaggaagtcttatcttctgcagtgagtatggcccaatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccaccgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataatgggaatttgtataaagcattactctttttcaataaattgttttttaatttaaaaaaaggaaaaaaaaaaaaaaaaa

SEQ ID NO: 148 - DNA, 304 bp, Homo sapiens
cagccaccctgtctgtgtctccaggggagagagccaccctctcctgcagggccagtcagagtgttagcagcagcttagcctggtaccagcagaaacctggccagcctcccaggctcctcatctatggtgcatccaccagggccactggtatcccagccagggtcagtggcagtgggtctgggacagagttcactctcaccatcagcagcctgcagtctgaagattttgcagtttattactgtcagcagtattatgattggccccggacgttcggccaagggaccaaggtggaaatcaaacgtaa

SEQ ID NO: 149 - DNA, 304 bp, Homo sapiens
tctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaataa

SEQ ID NO: 150 - DNA, 325 bp, Homo sapiens
ccatcttctgtttctgcatctataggagacagagtcaccatcacttgtcgggcgagtcagggtgttagcaggtggttagcctggtatcaacagaaaccagggaaagcccctaaactcctgatctatgctgcaagcagtttgcaaagtggggtcccatcaaggttcagcggcagtggatctgggacagatttcactctctctatcagcagcctgcagcctgaagatttcgcaacttacttttgtcaacagactaacagtttcccgctcactttcggcggagggaccaaggtggagatcaaacgaactgtgggcccaccatctgtaa

SEQ ID NO: 151 - DNA, 2068 bp, Homo sapiens
ggcacgaggtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttttagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttgtaaaaaaaaaaaaaaaaaaaaaaaaaaaaaaaaaaaaaaaaaaaaa

SEQ ID NO: 152 - DNA, 2091 bp, Homo sapiens
gaattccacctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaacttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattaaaaaaaaaaaaaaaaaaaaaaaaaaaaaaaaaaaaaaaaaaaaaaaaaaaaaaaaaaaaaaaaaaaaaaaaaaaaaa

SEQ ID NO: 153 - DNA, 1104 bp, Homo sapiens
cctgctctgtagagccggcggcaaccgggtagcttggccaggttgtgaggaaccgcagcgcccgcaggaccgggccgctgagcctgcagccgccccgcgccgtgacctgcgaccctagaccccgactaccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaaaaaaaaaaaaaaaaaaaaa

SEQ ID NO: 154 - DNA, 1065 bp, Homo sapiens
ccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaac

SEQ ID NO: 155 - DNA, 1382 bp, Homo sapiens
agaacatccggcgaagaagctcaggagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaaaaa

SEQ ID NO: 156 - DNA, 876 bp, Homo sapiens
gccgctttttttttttgcctcagccacttccttccttggcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgagaaatattatgatgtttatgtaataaagacatgtaactgtcttaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 157 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 158 - DNA, 1748 bp, Homo sapiens
  Modified_base 51: n = a,c,g, or t
aagaacgggcccaccgcgttcggggttctcctcccgsrgangggaacccaaaccctgtctctttccccakgtttcggaggaggctttggatacgtcctcggcggaatccactgggataaaacgggcttcgggagggccctggggggacagttccgagtcatwwacctcttcactgcggtcaccctgagygtcaccaccgtcctgaccctggtcagcatccctgagaggccgctgcggccgccgagtgagaagcgggcagccatgaagagccccagcctcccgctgcccccgtccccgcccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccaaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggagacgcgcctgcacctgggggtctggagcaggccgaccagtgaggaccaaagggccttgttggacagggggacaggctgcctactggaatgtaaatatgtgataaaataataaatgacaagcgc

SEQ ID NO: 159 - DNA, 3038 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaagcgggcgggcggagaggagagatggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcaacgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgaaatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccttcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagaaaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggactaccccagagggcagcagggcctttacccagtggcctgttggctagcctgggcctccctggagagggttgacagtggaagggaacaggaggggcatttggcctgagacccctgcttttgggaaaggctagcagggtggttcctgcccagcatgcccagctcctccctgggtgactcggaatctttcccatgtcaaaacccccaaatgggggtacaaagaacacctttctggaaccccctataacatccaaatttctttctgggctctcttgccttttcccccctttcacaaatggcacccctgggcatctgtccttgcctaagttattttggaagttggtgccttcctgggaactaaccaccaacttatctgcttcccttcccctggcatcacttcccataagcctggggtttctaaactggggcctggccacccctttccccactccaagagtgagtcggcctccagagaagactggcacaattccaactagagtcaacccatgctgccttttgcccttcccattcagatttagatcctgctttcatttttggctagtgaagtagatttttgtgtttttgaggtttattagcaggtttgctcaggaaccaaattaatgagtagttttatattgggccaccccaatatatggctttgggggctgaaaaagcagatgtagaccccctccctcggatccttattggtgtgccctttagcattccgcagattttgcggggtgaacaggagtgatgataaaatttttcattttaacaaaaaaaaaaaaaaaaaaaaaaaaaaaaaaaaaaaaaa

SEQ ID NO: 160 - DNA, 1282 bp, Homo sapiens
gggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaaaaaaaaaaaaaaaaa

SEQ ID NO: 161 - DNA, 1823 bp, Homo sapiens
  Modified_base 1677: n = a,c,g, or t
atgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacgccgaggtcaagcgcgtgggagacacggtgctggggatggccacgcagtgcgtgcagatgaagaacgtgcagaggaccacgccacagaccctgtccaacctctggctgaagatcaacgtcaagctgggaggcgtgaacaacatcctgctgccccagggaaggccgccggtgttccaggagcccgtcatctttctgggagcagacgtcactcacccccccgccggggatgggaagaagccctccattgccgccgtggtggggagaatggacgcccaccccaatcgttactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaacttggattttgactgcagactgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatncagaggcgtccgcaggtgccgtgttctgccagcaccgcccttcacccggcctgaactaaggagcagtgccagaaggtgggccccgtgtgtttacagcatttccaggtccagagaggttggcagacaagtgccattttaataaaaaa

SEQ ID NO: 162 - DNA, 1642 bp, Homo sapiens
aaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccataaaaagggatggttcatcattgtgaaagaaatggttatctcattggggaagaaaaggggagggggaaggcaagaatcactgaaaaatcttaaatctgtgttttctggaataagatatctagacagcctaaatctgattttagtttttataaaaataatgtcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaaaaaaaaaaaaaaaaaaa

SEQ ID NO: 163 - DNA, 1876 bp, Homo sapiens
caaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatcttctcaggagtaatacaaatcaggtatttcatcatcatttggtaatatgaaaactccagtgaactcccaaggacatttacaacatttatattcacacgctgtatggaagggtgtgggtgtgtgtgaaggggcgagtggagacactgtgtgtatctctagataagaagatatgcaccacgttgaaaatactcagtgtagatctctatgtgtataggtatctgtatatctttccttttgtttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagttcttggagaagaaagagcatttctttaagtacctggggaatacagctctcagtgatcagcagggagtttatttgaggacatcagtcacctttggggttgccatgtacaatgagatttataatcatgatactcttcggtggtagtttcaaaagacactactaatacgcaggaagcgttccagctatttaatgctggcaactactgtttaatggtcagttaaatctgtgataatggttggaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttctaaaaaaaaaaaaaaaaaa

SEQ ID NO: 164 - DNA, 1641 bp, Homo sapiens
ctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtggccctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaaaaaaaaaaaaaaaa

SEQ ID NO: 165 - DNA, 2586 bp, Homo sapiens
gtacattaaaaataatttaatagccacaatatgatgttctttaagctgcaaattgagtacactgggaatcaacaaatttgatgaagcctgtctgtctcttcaccagtggagtgagtgcagcagttagaaagagaagcaatattgtgcaactggtgcagtggtgagttaatcatagtgtataaccttgtgttcatgaaacaggttgttcattgttctgcatctctcttcatttaaaaaggatacacaattctttcctcattgcatattacaccaaacgtttgagggaaaaatcctcattcgtaaaggattttggatttataatctaaaactcaacaataaagaaataatattccaagtctctggtttcctaatatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctcataaagtagaactgatacaaattttggttggatatatagagaattttataaatgtattgccttagaatttctgggtggagacccaactacaatgacattgtcatgcaagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaagcaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgattttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctgaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaattaaaaaaaaaaaaaaaaaaaaa

SEQ ID NO: 166 - DNA, 1804 bp, Homo sapiens
gtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagccaaaaaaaaaaaaaaaaaaaa

SEQ ID NO: 167 - DNA, 3960 bp, Homo sapiens
gcgggggcgggctttgccgagcgcagagctgcagccgccgagccggacgtgtgcgcgaagatggcgggccggagcatgcaagcggcaagatgtcctacagatgaattatctttaaccaattgttcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcaatgactccaacccttatgacaccgacaagatggcagcagaatttattcagcaattcaacaaccaggcctactcagtgggacaacagcttgtctttagcttcaatgaaaagctttttggcttactggtgaaggacattgaatccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgccttccgagtatttcctccagagattgtggagcagatgggttgtatacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttaaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaaaaaaaaaaaaaaaaaaaaaaaaaa

SEQ ID NO: 168 - DNA, 660 bp, Homo sapiens
gatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaaagataaatcccctaatgccaagggtctagtgtgttcttagtggttatactgggaagtgtgtggagatttaggtgctgctcttgctgctctggatggcttgaaggctcctgggccatcttcatgtgctgcttgaagagctcctattttgtactcctggctagaatgctggtggaacaaatacaaaagtgaaaaaagttctctgtagatttctgaagtgcatattcattgatgccaaggaaaaaaaaaaaaaaaaaaaaaaatttggtcgtctttcgcagccgtaaatcaagccttattccgataccgc

SEQ ID NO: 169 - DNA, 1780 bp, Homo sapiens
gcagtagaggcgcggggtgcggagctagggaggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttaaaaaaaa

SEQ ID NO: 170 - DNA, 2785 bp, Homo sapiens
aattcgcggccggctcgacctgaacctcagccgcgccgggaggcagcccgttggcgaggggcggggcggatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcggggcacgccgtactggaggttgcgcctcggtggccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcggggggaaccctcctcctgggcattgcatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgtgacggcacccagcgctgtggctgtcattctcccagggcagaaccctgatgcttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacgggactccagtacacagtctgataagactaacgtccctaaccctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctacgtgtgccagcaggatgtgggaggtaacggatgagcaggacgctgcagctctctccagccctgttggacatcctcagtgcctgcaggcctctcgctgcctgttgggctgtctggggggtggccatttagggatcgtggggacggggtccaccccaagaagaaagaaaggccgacgtccacaggcccggctctggccacgtgccccggaagcaggtgtgtccagagtcagctgagggctctccccacaccaccagcaggcgctggtgctccttctgcctcatgggaccagtccagcttccagcgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgtggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactctgcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagatttcctaagtattttatagcgaccatcaaaattggactttgtattgtttattcataaaagacacttggtaatagacttcagtgaactctgtatgaatgcagtagtgtgcgtcgaaaatccgcttcctgagcgtagggtgctgcagtggcgctagggcctggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtgtttaaaaaaaaaaaaaaaaaa

SEQ ID NO: 171 - DNA, 1414 bp, Homo sapiens
cgattgaggaacccatttcctcattctgcaaattgcaaacctgagggcccaaagagggacaggggcttgccaggtctcagcaggctgtgagcaagagctaaagcctaatcctcctgcctttgggctggagccttccttgtaccccagggtcagtgtctttgttggatacaggcttagattgactgactgtaccctgagaacctaggggagtccctgttcccaattcttctcctacccccaccttggcctgatggaggaagaccctgctgtgttgagatgagcaccagagccaagaagctgaggaggatctggagaattctggaggaagaggagagtgttgctggagctgtacagaccctgcttctcaggtcccaggaaggtggcgtcacatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgtcggtgcagcatgcggactcactggagaacatcgacgagagcgcggtggccgagagcagagaggagcggatgggcggcgcgggcggcgagggcagcgacgacgacacctcgctcacctgagcgacgcaccgcttcagggacggagacaggaccggcggagccctggggcggcggccgc

SEQ ID NO: 172 - DNA, 2394 bp, Homo sapiens
atgaagaccagggggttcagctttccaagacaaaggcaagtcctgtttctttttcttttctggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcactcgccagtgtttcggcacaaagagatggtcttaaaaatatcagaaaatacagctgaagggacagcatttagactagaaagagcacaggatccagatgaaggtcataacagtatccaaaactacacgatcagctccaactcttttttccatattaaaattagtggcagtgatgaaggcatgatatatccagagctagtgttggacaaagcactggatcgggaggagcaggaagagctcagcttaaccctcacagcgctggatggtgggtctccatccaggtctgggacctccactatacgcattgtggtcttggatgtcaatgacaatgccccacagtttgcccaggctctgtatgagacccaggctccagaaaacagtccagtagggtcccttattgttaaagtgtctgcaggagatgcagactcaggagtcaatgcagaagtatcctattcattttttgatgcttctgaagatattttaacaacgtttcaaatcaatcctttttctggggaaatctttctcagagaattgcttgattatgagttagtaaattcttacaaaataaatatacaggcaatggacggcggaggcctttctgcaagatgtacagttttgataaaagtattagattccaatgacaatcctcctgaactgatcatatcatcactttccaactctgttgctgaaaactctcctgggatagtattggctgtttttaagattaaagacagagactccggagaaaatggaaagacaatttgctatgttcaagataatctgcctttttttctgaaaccgtctgttgacaatttttacatcctaatgactgaaggtgcactggacagagagagcaaagctgagtacaacatcaccatcaccgtcactgacttggggacacccaggctgaaaaccgagcacagcataaccctgcaggtctccgacgtcaatgacaacgcccccgccttcacccaaacctcctacaccctgttcgtccgggagaacaacagccccgccctgcacatcggcagtgtcagcgccacagacagagactcaggcaccaacgcccaggtcacctactcgctgctgccgccccaggacccacacctgcccctcgcctccctggtctccatcaacgcggacaatggccacctgtttgccctcaggtcgctggactacgaggccctgcaggctttcgacttccgcgtgggcgcctcagaccgcggctccccggctttgagcagcgaggcgctggtgcgcgtactggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctggtggtgcttgtcaaggacaatggcgagcctcctcgctcggccaccgccacgctgcacgtgctcctggtggacggcttctcccagccctacctgcctctcccggaggcggccccggcccaggcccaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgagcggcaccgggaccctgttccagagctaccagtacgaggtgtgtctgactggaggttcagagaccggcgagttcaagttcttgaagccgattaccccccacctcccgccccataggggtgggaaagaaatagaggaaaattctactctccccaatagctttggatttaattattga

SEQ ID NO: 173 - DNA, 2436 bp, Homo sapiens
gcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggagggaatttatactgtgggcgtttaccaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggcagagctagtcagcaaatcaatgcacttcgtagtgaaatcacacgacttcagatggagctcatggagtacaaaaccaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaacccaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcattgaagaaattgcagcaggatgtgatggaaatgaaaaaaacaaaggttcgcctaatgaaaa

SEQ ID NO: 174 - DNA, 2222 bp, Homo sapiens
gctgggcggtcattgggcggcgtgatctcgccgcggttccgcggccctgccgccgccgccgccagcagagcgcaccgggccgatcgggcgagtggccatggcgggcgccgaggactggccgggccagcagctggagctggacgaggacgaggcgtcttgttgccgctggggcgcgcagcacgccggggcccgcgagctggctgcgctctactcgccaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctgtcacctgagacagtgaattaatgttgacatctgctccaaagccttttggaggggattgggtgaggacagtggtctttcctgttgatcatgatgataaagtaatgatggctgatccctatttgtgacttccttcagcaaatattcactggcacctggtgtgtgccaggctctgtcctgtacacaggtacagcggtgaaagaaccaacaaagacctatcctggtggagctgacctcctgggaaaagagtcaataaacaaataaatgcacatggaaattcaggtggtgatttgtgaagaaaatcaaacag

SEQ ID NO: 175 - DNA, 2024 bp, Homo sapiens
cgggacgcagcaaagagaggagagaccccaagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccccttaggactctgaagggtatggacctacgtgaatgtgtgtcagggggagacttgctggtgggttagtggtcctcaggatgtgataaaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctaaagtgggactggggagggagctaagcttgggctgggctgcttggggcttggcatagggtggaaagggctaccctggggcttctgacccccctgtagtatgtgtggagggtgccctcccgtctcccacaacttctgctataacaataaactgtagaggaatcggaaaaaaaaaaaaaaaaaaaaaaaaaaaaaa

SEQ ID NO: 176 - DNA, 782 bp, Homo sapiens
aggcgtgcgaggagggggcatggcggatactgtgttgtttgagtttcttcacacagagatggtggctgagctgtgggctcacgaccccgaccccggcccggggggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacaagctttcccctcctcctcccgatggcctctggcctgcagtatctggaggaagcacccaagttcctggccttcactgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaaaaaaaaaaaaaaaaaaaaaaaaaa

SEQ ID NO: 177 - DNA, 2801 bp, Homo sapiens
gcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataagaattgtaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagtagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtccctctcctccacatttgttttgccaatttgcacattaatgactcttcccctcgt

SEQ ID NO: 178 - DNA, 2579 bp, Homo sapiens
aagctggccgaccagtacccgcacctgcacaacgccgagctcagcaagacgctgggcaagctgtggcgcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggccccagtggctgagctccaagtgcctgctgaagtctgcagggaaacacgcttgctgcccgtggccctcggcctccagatggccacacctctgccgacgacggaccagctccctctcccttctatctttctttttgaggtggtgggattattccacaaagaagggctgccgtttggtccctcttccgtgaggactggcggcaccagcaccttcgctttgcatctcggtagaggagaaacggcagcacagcccaaggaccaaaggagggggtggcaggggccttgcagggcgctgtgaggtccaggccggtcttggcgccgagagcccctgcactcaaggccacattccctcgacaacggctgcacgggctgtccgggatccggggtgtctgtccgcagactgggatgagtctactcgagcatctccgggacctgcctgtcagatctgaggtgtctccttgctggcagagtgcgctcacgcgagggctggctgtgatgaacacatctctcttttatttttatgtttttgataatttttatttttgaagcttaaatgtgtttcttctgaaagctgttaaagatgtatttatgttctgtgttattttatctttaattaatgaggtaattcgggcaaagagtagaatttaagacaaaacggaagctgggaagcttcccttgagggcaggcaggaggtggagttgcagctgttggccggcatcacgttgctcgttgctcggcttatgggaggccgccctggagggcccggaggtcccaaggtccctgggaggactgggcccctcatgcctcgagcttggcaaccgaaaacccgagggaggagaagggacctgccttgtgacatctctgatcaggttggggtgccccagcacccagtaccagtttggggtttgggaagcaggactccgtccctgtccccgactgtgccacgtggtaggacacataggacacaggaattcctgggtccttgcccatgactgtgccatgtggtaggacacaggacacaggaattcctggaaagtggtggcttcagaagtgatcttggctcgcaggcaccagtgccacctaccaagctgtgaaactaaaccttctccactaaacgtcgttagggcctcagttctagacgagtcatacctgattcacctgcactgcttcccctgtgtgctgagcatagagcatacaatagcgcctacttcacggaaacttgtgcctttaaactttgtaaacttaaacacagccgagaagttgcttctttgtactttttctacttttcctacttttttgtagaaaaaaaagataatgcctctgcttctatttctctgggggtgggggtgggggccgggagccgtcgcagacccgtttcatgcagcgtctccctyggcaccgcgttcggaggacgcaccctcactcccctgctgccttcactcctttctgaccaagcaacgctaacttttgtacagatcgatttgataaaattaaacaaagtgctttttatgg

SEQ ID NO: 179 - DNA, 5601 bp, Homo sapiens
ggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcactgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctggattttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatcaaaaaaaaaaaaaaaaaa

SEQ ID NO: 180 - DNA, 1547 bp, Homo sapiens
ggtggcttcctcacctccacctgtaatgcaggagggagaattggctatttctcctataagccctgtggcagccatgcctcccctaggcacccacgtgcaagccacatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgaggtgtggatccaaatgggctcgccagactctggggaaatcacaagaaccgggtggacatgacctacgagaagatgtctcgtgccctgcgccactattataagcttaatatcattaagaaggaaccggggcagaaactcctgttcagatttctaaagactccgggaaagacggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaagcctgggaggcctcccatccaggacactgggggcaggagtgtcatcttttggggcagggcaatcctggggctaaatgaggtacaggggaatggactctttggggggtacttgcaacccccttgggaggagggaaagccaaggcaacgatagagcacccagccccacccctgtaaatggaatttaccagatgagggaatgaagtccctcactgagcctcagattctcctcacctgtgcaaatgggctgaggcaggaaatgggaaaaagtgttagtgcttccaggcggcactgacagcctcagtaacaataaaaacaatggtagctgaaaaaaaaaaaaaaaaaaaaaaaaaaaaaaaa

SEQ ID NO: 181 - DNA, 1203 bp, Homo sapiens
catctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacgtcaatgcactgggttgtcagaggtaaaaaagacctgatgctggaagaatctgacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagattcttcaggttttgcagatgtgaatggttggcaccttcgtttccgctggtccaaggatgctccctcagaactcctgaggaagttcagaaactatgaaatatgaaatatctctgcttcaaaaaatgaggaagagcaagactgtcccctatgctgccaacatgcagtctttgtttatgtcttaaaaatgtcatgtttatgtcatgtctgtgaattgctgagtactaattgattcctccatccttgaatcagttctcataatgctttttaaataagaaaaattcagaagatgaatttcttccaatatttgaataaattaaagctcttagatacagagtagattgtattatatgctttttcctattaatactacttatagaaatccattaaaaagcaatctctgtacagtgtatttaaatatttcattgacatactgtgatctctattagtgatggatgtacaaaaaatgttttcttacccttgacttacaatgaaatgtgaaattacttgtctgaaccccgtggggagaaataaataattttcccaaagttcaaaaaaa

SEQ ID NO: 182 - DNA, 5111 bp, Homo sapiens
ctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcgatccgtaatgcctcctgcctgcctctttcaagatggaggtgaaacctgtgggagaacctactcaagaggtgtctaaattcaaactttccaccaaggtagaaagcacgggacactggctggtggaagatcatgttcgaatatgggaagttttaaagacagaggagagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagttacagacacagcaaaatcaccctctgaagggagggmccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactgacgtktgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcctaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaagggaaaaaaaaa

SEQ ID NO: 183 - DNA, 969 bp, Homo sapiens
acggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtaaaaaaaaaaaaa

SEQ ID NO: 184 - DNA, 1581 bp, Homo sapiens
gagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagattctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatcccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagtgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaaaaaaa

SEQ ID NO: 185 - DNA, 2687 bp, Homo sapiens
ccagttagagctcgggtctcctcgccacagctccgagtctttcgttctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcacagaagcttcattccaaaaagtgatatcgaggagacatgggagctgtgatcttgagaatttacatttaagaaaaaggtggaaaagggaggagtgtgaagggcacaatggatgttatgatgaaaagacttttaaatatgatcaatttgatgaatcctctgttgaaagtttgtttcaccagcaaatactttcttcttgtgccaaaagctataactttgatcaatataggaaggtctttactcattcatcattgcttaatcaacaagaggaaatagatatttggggaaaacatcacatatatgataaaacttcagtgttatttaggcaggtctctactctaaatagttaccgaaatgtttttattggagagaaaaattatcattgcaataattctgaaaaaaccttgaaccaaagctcaagccctaaaaatcatcaggaaaattattttctagaaaaacaatacaaatgtaaagaatttgaggaagtctttcttcagagtatgcatgggcaagagaaacaagaacagtcttacaaatgtaataaatgtgtagaagtttgtacccagtcattaaaacatattcaacatcagaccatccatatcagagaaaactcatatagctataacaaatatgataaagatcttagtcagtcatcaaatcttagaaagcagataatccataatgaagagaaaccatacaaatgtgaaaaatgtggggatagcttaaaccatagtttgcaccttactcaacatcagatcattcctaccgaagagaaaccctataaatggaaagaatgtggcaaggtctttaaccttaactgtagtttataccttactaaacagcagcaaattgatactggagaaaacctttacaaatgtaaagcatgtagcaaatcttttactcgttcctccaatcttattgtgcatcagagaattcacactggagagaaaccatacaaatgtaaagaatgtggcaaagcctttcgctgtagttcataccttactaaacataagcgaattcatactggagagaaaccttataaatgtaaagaatgtggaaaagcttttaaccgtagttcatgccttactcaacatcagacaactcatacaggagaaaaactttacaaatgtaaagtatgtagcaaatcttatgctcgttcttcaaatcttattatgcatcagagagttcatactggagagaagccttataaatgtaaagaatgtggcaaagtctttagccgtagttcttgccttactcaacatcggaaaattcatactggagaaaatctttacaaatgcaaagtatgtgctaaaccttttacttgtttctcaaatcttattgtgcatgagagaattcatactggagagaaaccctataaatgtaaagaatgtggcaaagcctttccttatagttcacaccttattcgacattatcgaattcatactggagaaaaaccatacaaatgtaaagcatgtagcaaatcttttagtgactcctcaggtctttctgtgcatcggcgaactcatactggagagaaaccctatacatgtaaagaatgtggcaaagcctttagttatagttcagatgttattcagcatcggagaattcatactggccagagaccctacaaatgtgaagaatgtggcaaagccttcaactataggtcatacctcactacacatcagagaagtcatactggagagagaccctacaaatgtgaagaatgtggcaaagccttcaactctaggtcatacctcactacacatcggagaagacatactggagagagaccctacaaatgtgatgaatgtggtaaagccttcagctataggtcatacctcactacacatcggagaagtcatagtggagagagaccctacaaatgtgaagaatgtggcaaagcctttaactctaggtcatacctcattgcacatcagagaagtcatactagagaaaaactttaaaaatgtaaaacatggagcagattttttacttgttacccatgtcttattgtgcatcagataatttatatgggagtgaaaccctacaaatgttaagaatgtggcataacctttaactattttcaagccttacacaatagcagagaatataaactgaaaaaatccatacaaatattaaaaatgtggcaaattattttaaactgtgctcaacccttactcaagataatccatactagagaaacactatagatgtaaaaatgtgaaaagttttattcaaaatatcaaacttatgagtc

SEQ ID NO: 186 - DNA, 926 bp, Homo sapiens
ctttgaattcctagctcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgacatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctgtcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctattaatgtatttaattttttacttgggcatgaaactttaaaaaaaattcacaagattatatttataacctgactagagca

SEQ ID NO: 187 - DNA, 3348 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaaggaaaaaaaaaaaaaaaaaaaaaaaaaaaaaaaaaaaaaaaaaaaa

SEQ ID NO: 188 - DNA, 7787 bp, Homo sapiens
gagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgctacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccgaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccactgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagct

SEQ ID NO: 189 - DNA, 2125 bp, Homo sapiens
tggcgatggcgtacttggcttggagactggcgcggcgttcgtgtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccatacacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgaggtaagagttactgacctttgtctgatcccagagggcccgttcttagtcatcaaagtggtatttagttgagcaaaagtgcaatatctgcttctctgtgtcagtgcagttaattgtgactttggacaagcatatttctctaaactggctccatccataggtgggcattcattctttctctttgacctctgttacctgttcatcctgctggtctcatgagatttgactggaaaacataaaagtgagctatagttgtaaacaaaattatcttgcattgaggcagaggaatttagcaaattctcatccagccagaggaatgggagatttccatgaacgctgaaggtaggagactcggaggagtcttgtaaacacaggaggaggtcatgaaggcttttctctttattcctgccaaatctgtaattcccacttgctgtgatattgcagcatgtgctcagtcacccaacctaatctctaagactgcggctggtttacagccctgaactcactgtccagaatacaagattcaaaccagggttgacccataggtctcactggttggtcttccatccactgccattcagacggatgccctggatgaatctggtgcggaagaccagggaagtggcaggacaaggaggcactgctggtggtggctgtggaaacacccagcctgacagaaggctttatctcagagtcagactgtcttgcccatgcttcagtcatgctgctttggcacatttaatgattttgtgtttccatttctgtagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgtcttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaccaaaaaaaaaaaaaaaaaaaaa

SEQ ID NO: 190 - DNA, 891 bp, Homo sapiens
aagcctacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaatgattgtagataaaatagacgcggataaagatgggtttgtgacggagggggagctgaaatcctggattaagcacgcccagaagaaatacatatatgacgatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacgacacgatgagttctaa

SEQ ID NO: 191 - DNA, 1371 bp, Homo sapiens
gctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacaatcaactccgcccctacccaaggaccgacagcggctcccggagcctgccaccctgggcttctcggcacgggggcaggggctggagctgggcctcccctccactccaggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagaaaaaaaaaa

SEQ ID NO: 192 - DNA, 8743 bp, Homo sapiens
cagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaagtgttttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgccacaagctacaaggatattgagtcgttgatgtctgagggtaacaaatctcgcactgttgctgcaaccaacatgaacgaggagagtagccgatcccatgcagttctcaaaatcaccctcacacatactctctacgatgcgaagtctgggacatctggagagaaagtgggcaaactcagcctggtggatttagctggcagtgaacgagcaacgaagacaggcgctgcaggggacaggctgaaggaagggagcaacattaacgagtccctcacaaccctcggtctggttatctcagctcttgcagatcagagtgctggcaaaaacaagaataaatttgttccatatcgtgactcagttctcacctggctgctcaaagacagcctcgggggtaacagcaagaccgccatggtggctactgtgagtcctgcagctgataactatgatgaaaccctctcaactctgcggtatgcagatcgagccaagcacattgtaaacaacgctgtggtgaatgaggaccctaatgcccgaattatccgggacctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcctagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatctcagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtcccctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatattgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccaggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccatatgtgtctttccatcaaatgaccaacagcttctcaataaaaccagaccatttctcacctgc

SEQ ID NO: 193 - DNA, 400 bp, Homo sapiens
tttttttttttgcacttatggtatttattgttggaagattgagtaccttaatgcacaccaatgctcagatgacttgggggcacataggggactgctgtcaccatgcctcactcctgcagggaaggggctgccctactaaaaccccagcgggcccagtgctgtgtccagaacaggtccttatattactgcagcccacaatggaactactgagtaggagccaaaagaggagggagcaggaagaggtggcatttggagaggggagaccgcacccacaggtctgccacagcgcgtcaacggtatggggtacttttacagtcaagttgacttcggtgtccgcccaccatctacctttgtaggaccactgaaacaagggacatccaccacggcccacagccggggc

SEQ ID NO: 194 - DNA, 4413 bp, Homo sapiens
agatccttccttctctcctccttcttcattctacaccacccccaacacatatccctgcaccccgcccattctttgctctctctcctttcttacacttaactccttcttgctccacagcctaacatgctgattaacaggaccccaaaggtttgggtgggtattaggggccttctcaacaaaagcagcacactcttgagcttgttcttccttttgttgccatctcagataaaaaggccccatgagggaggagacagataagtatagacttggtattctgataactctgtgttacatgggatcagatgtaaatgagttgtaccctgtggtgtttcatgctctgctgtgttgtcttctcatggtgagcttttctgtgcccttatttcatccagctctggtttctgtgtttcatgttatttctcctagcctctgtaaactctgcagcatactaataatgctctggctttctgattaaagataaatggcttactatcatcacccctggcttgagggccagctcacatgtaatcccttataggattccaaagttgttaaataaatgcagttctttttgtcattttgaagcattcaaaaatttttcaagaaaagctatgatcatataaatagaaattttatccagaatgttacagtgtagcatttgtgaataaatgtgtaggtgctgtatttgctcagactctagtttgggttgtgttttcttttccctttttttttttgagacggggtctctctctgtcatctgggctgcagtgcagtggtgtaatcacagctcactgcaacctctactcccaggctcaagcaatcctcctgagtagctgggactggagacatgcgccacaacgcccagctaatttttaggtttttctttcacatagacggggtctcactctgttggccaggctggtttcgaactcctggactcaagcagttccccccacctcagcctcctaaagtgctgggattacaggcctgagccaccatacccagcaagttatattttctttttccttatatagagtaaaataagggtgagtgaccgagaggttgatgcatagctagatcaccagtttaaatgccttcccacacacccctttcctcctgttccctccacctacaggttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgagcagatctgtgagctggctgatgccttgagtcgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaaatattcaagactgggacaaaagtataaatattatttatttcaggtagaatttttttggtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatggggtgtacctgtttatctgtaactgttatccaaacaaattaaatactgtggatgcctttaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 195 - DNA, 808 bp, Homo sapiens
ggggagtgtgctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagggagagacatgaagacagaggagaaatgaatgcataaaataactgataatatgaatctatacatagaacttaggaagtctcatctgcctgaaaatgactgtgtggatcccacccaaatccaactcatcctggtttgctgcacactggttcatcaaaagaaggttaccgaggggaaggaactaaaggtgtttgcacttcatgttactttttgagtttataaacataaaaacagaatttacttctgttacagacctagttactgggaattcattacttgccatggactacctttgctaagaaaagtctgaatgagaagatggcaggacgtctgaaaaaaaaagttataattaataaaatctgcggagaattgtaaaaaaaaaaaaaaaaaa

SEQ ID NO: 196 - DNA, 2478 bp, Homo sapiens
ggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggctgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaagtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtgcgctggacccctgtgtgcttggaacacaccagtgccagcacgtctgcatcagtgatggggaaggcaagcaccactgtgagtgtagccaaggatacaccttgaatgccgacaagaaaacgtgttcagctcttgataggtgtgctcttaacacccacggatgtgagcacatctgtgtgaatgacagaagtggctcttatcattgtgagtgctatgaaggttataccttgaatgaagacaggaaaacttgttcagctcaagataaatgtgctttgggtacccatgggtgtcagcacatttgtgtgaatgacagaacagggtcccatcattgtgaatgctatgagggctacactctgaatgcagataaaaaaacatgttcagtccgtgacaagtgtgccctaggctctcatggttgccagcacatttgtgtgagtgatggggccgcatcctaccactgtgattgctatcctggctacaccttaaatgaggacaagaaaacatgttcagccactgaggaagcacgaagacttgtttccactgaagatgcttgtggatgtgaagctacactggcattccaggacaaggtcagctcgtatcttcaaagactgaacactaaacttgatgacattttggagaagttgaaaataaatgaatatggacaaatacatcgttaaattgctccaatttctcacctgaaaatgtggacagcttggtgtacttaatactcatgcattcttttgcacacctgttattgccaatgttcctgctaataatttgccattatctgtattaatgcttgaatattactggataaattgtatgaagatcttctgcagaatcagcatgatttttccaaggaaatacatatgcagatacttattaagagcaaactttagtgtctctaagttatgactgtgaaatgattggtaggaaatagaatgaaaagtttagtgtttctttatctactaattgagccatttaatttttaaatgtttatattagataaccatattcacaatggaaactttaggtctagtttcttttgatagtatttataatataaatcaatcttattactgagagtgcaaattgtacaaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaatataataaaagttattacctttacatatt

SEQ ID NO: 197 - DNA, 1857 bp, Homo sapiens
gacccacgcgtccggctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccgtggctccgagactttcatgatcccgttgtcgaggttgaggtgtccgtgttcccggcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcgcctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttaaaaaaaaaaaaaaaaaaa

SEQ ID NO: 198 - DNA, 819 bp, Homo sapiens
atggccgaggtgcagctggtggagtctgggggaggcctggtcaagcctggggggtccctgagactctcctgtgcagcctctggattcaccttcagtaactatagcatgaactgggtccgccaggctccagggaaggggctggagtgggtctcatccattagtagtagtagtagttacatatactacgcagacttcgtgaagggccgattcaccatctccagagacaacgccaagaactcactgtatctgcaaatgaacagcctgagagccgaggacacggctgtttattactgtgcgagatccagtattacgatttttggtggcggtatggacgtctggggcagaggcaccctggtcaccgtctcctcaggtggaggcggttcaggcggaggtggcagcggcggtggcggatcgcagtctgtgctgactcagcctgcctccgtgtctgggtctcctggacagtcgatcaccatctcctgcgctggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggagggaccaagctggccgtcctaggtgcggccgcagaacaaaaactcatctcagaagaggatctgaatggggccgcacatcaccatcatcaccattaa

SEQ ID NO: 199 - DNA, 807 bp, Homo sapiens
atggcccaggtgcagctgcaggagtcgggcccaggactggtgaagccttcggagaccctgtccctcacctgcactgtctctggtggttccatcagtagttatcactggagctggatccggcagcccccagggaagggactggagtggattgggtatatctattacagtgggagcaccaactacaacccctccctcaagaatcgagtcaccatatctgtagacacgtccaagaaccagttctccctgaacctgaggtctgtgaccgctgcagacacggccgtgtattactgtgcgcgaggaacgtatggcccagccggagatgcttttgatatctgggggcaagggaccacggtcaccgtctcgagtggtggaggcggttcaggcggaggtggcagcggcggtggcggatcggacatccagatgacccagtctccttccaccctgtctgcatctattggagacagagtcaccatcacctgccgggccagtgagggtatttatcactggttggcctggtatcagcagaagccagggaaagcccctaaactcctgatctataaggcctctagtttagccagtggggccccatcaaggttcagcggcagtggatctgggacagatttcactctcaccatcagcagcctgcagcctgatgattttgcaacttattactgccaacaatatagtaattatccgctcactttcggcggagggaccaagctggagatcaaacgtgcggccgcagaacaaaaactcatctcagaagaggatctgaatggggccgcacatcaccatcatcaccattaa

SEQ ID NO: 200 - DNA, 331 bp, Homo sapiens
cagtctgccctgactcagcctgcctccgtgtctgggtctcctggacagtcgatcaccatctcctgcactggaaccagcagtgacgttggtggttataaccatgtctcctggtaccaacaacacccaggcaaagcccccaaactcatgatttatggtgtcagtaatcggccctcaggggtttctaatcgcttctctggctccaagtctggcaacacggcctccctgaccatctctgggctccaggctgaggacgaggctgattattactgcagctcatatacaagcagcagcactcgggtgttcggcggagggaccaagctgaccgtcctag

SEQ ID NO: 201 - DNA, 2073 bp, Homo sapiens
ggcgccaggttatgtaccagcaaagtagcgggcgcaacagccgcgccctgctctcctacgacgggctcaaccagcgcgtgcgggtgctggacgagaggaaggcgctgatcccctgcaagagattatttgaatatattttgctgtataaggatggagtgatgtttcagattgaccaagccaccaagcagtgctcaaagatgaccctgacacagccctgggatcctcttgacattcctcaaaactccacctttgaagaccagtactccattggggggcctcaggagcagatcaccgtccaggagtggtcggacagaaagtcagctagatcctatgaaacctggattggcatctatacagtcaaggattgctatcctgtccaggaaacctttaccataaactacagtgtgatattgtctacgcggttttttgacatccagctgggtattaaagacccctcggtgtttaccccttcaagcacgtgccagatggcccaactggagaagatgagcgaagactgctcctggtgagcctgtgcatagggaagcggcagcatcggatgtcagccccctgcggccccagctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtggccatatgaactgactagatggctaatatggacactttgggtatttctaatgcctgttcagggctggttttctgcatgcacgggtatacacataatgcagtgccatgcacatagggaagggtcagtaagagaagtttgccttggcagcaagtatttattgttgacattattcagaattagtgataataaaaagcagagtgattttggtcaattttattattaattcttaaattccctgcagagaatgccccctttattgctgcaccagggtgggcattgctcccactgagccctactccaccctgtccctgcactcccttggttgccaaaaaaatgataacttaaatcccttccagacttaagaattttatggcatggcccaattgatataaacatttagaaggaaatgaaaagctaaaataggaagtaattattcctctaaagaaacattttgagcaaggcagtttagagaatcctaatgtctacactggcatagcacgagccatgtaagcttcttttttttctatgcaagagtattgatgtatgtgctgaatcttcacagacttgtcaatacacaggcagtattctaaaatagccctgaacagggagtcaggagactattgtctcctaaacccaggactagagttccctcgtactgtcactcctttggtcattaaatgcactgggcttgcccgcactttggccttcctagaacgctgcttcataacctctctgtctgacttctgcatctccttccaggtcagctcattcacaagagttgctcccaagcctggatgagttgcaccttgcatcttgagcatgcatttctcacaataattattaagctgtgtgataatttctgctttcaggacactcatccattatcttggctgtgagctccttgggtacgggtaccttgtatgtttaattttatatccctagcacaaagcaagtgcctggcacatagtcagtgccctaagtatttgtagagtgaagaatgccagcctctcttgtccctggtttccttatgtgttgaatgtggttgagtttgtccattgctagggagagacttccagtaataaaatttactattctagatgcttctactgttatgttttatctacccatttatctttcttagttaccaggagaaatgtgtgacacctatattataatgaaaacaatcttattacttatagtttatctatattaaacaaatttaattgcatttaaagcattctttgatattgttgcttttgcaataaatatggataatcttggttataagggagttaaaacaatgctgtaataaataaagtgtttcatgtgatcaaaaaaaaaaa

SEQ ID NO: 202 - DNA, 3919 bp, Homo sapiens
cccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggtgcacgaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacagtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctggagagagacctgccagaccccctggaccagaaggtcgtcacctgggagacagtccagaaggagaacttcctgagcaagatggagaagcggaggagggacagcgagggggaggtgctgcggaaaaccgcccacagagtggacttcattgccaagtacctcgggggtctgagagagcaagaaaagcgcatcaagtgtctggagtcacagatcaactactgctcggtgctcgtgtcctccgtggctgacgtgctggcccagggtggcggcccccggagctctcagcactgtggcgagggaagccagctggtggctgctgaccacagaggtggtttagatggctgggaacaacccggggctggccagcctccctcggacacctgagctgcttggcctgccacgtgtggggccacctctcctcagctggccaccctgcacgttgtgcactgacctttgccgacctccagcggaaccccccagggggcaccagccccccagcagacaatggccctcctggtgcctcaccacagaccctcacccaaaggaaccgctccttgtccctcctggcctccccggaggcacagcagtgtcatggggctgtctcccctgacaggcacaactccccgggcagaaaacgtgccccaccgcatccctacctggaaactgaccagcctgcactgtggaaaagctggccctgtggcgtgacgggggagcacccccatccagactgcgaagctgctctggggtctgcacccacccctgccctgacttgtgttgcctgacaagagactcatctttttttgaaaaaaaaaaaaaaaaaaaa

SEQ ID NO: 203 - DNA, 1956 bp, Homo sapiens
ggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaact

SEQ ID NO: 204 - DNA, 873 bp, Homo sapiens
ccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatgtcagttcaggaccaggacagggatggggcctgggtgggtggcggtcacagcgtggcagggtgggggctgggatccgcctacaccccacggtcaggctgctagaaacctgggaacaccccagcacagggtctcagaacagagacctggtacaccaggcccgccgccacccgagggagcccagggagatgggtgcagaggtgtcgcctttaacgtgatgttctctgcccctcacatttagccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgaaaaaaaaaaaaaaaaaa

SEQ ID NO: 205 - DNA, 1111 bp, Homo sapiens
gcggccgcgaattcggcacgagcagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcacattgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactgcccctaagtctctgctcaaaaaaaaaacaattctcggcccaaagaaaacatacagg

SEQ ID NO: 206 - DNA, 4670 bp, Homo sapiens
ggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcatccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagaggtgggtgctcccagctcctgctcccctcctggtggcgcggcagagcctccagacacctgctcctgtgccccagcagctctagctgcctctgctttcggagtgtccctgggaccaggatagatgtgggtgtgtctcagtggggcccccaggctgggaacacactcggaagatcccgtgtgtgcacgctggcttctcgggaccagccagggccaaggcttgggaaccatttgcatccaggagttagatgggaacaagtgtcactcctggtcacctggttggagggcatggattgaagctgccctcaagtccaggccttgaggcccacctgaggggagatactgcccttctctctgcctgcctcacctccagctgtcagagggtgagcagggccctggaggcaggcaccccctcctcctcctccccgtccccttctcctcctcctccccgtccccttctcctcttcctctccctccttcctctccctccgcctcgctgtctttctccttctcctctccctcctcctcctgctccttctcctccccgtaccctttttctactcttccctctccttctcctcctcctttctctccctcctcctccccctccccttctcctcctctctttctcttcctcttttcctcctccactcctctttctgagagtagctgctgctttccctgccttccttcctcaagaatacagtctattctggggggttgcaggacagctgaaaaagaaaacgtgagtttccagaaaagcacatcgccctttctctccactcgacacagcctgcggtttgcagtgccagctgcacgttggagtctcctgggaagcttctagtgttgatctccctcctagaggctcagtgaggtgatcggggggtcagtgtgttttcagagtcccagctgctctgacttacagctgtggttggagccctgacctaggtccttggtctaagaagtcaaggatgtaagtctattaggactgagtgttgaatggtcttgatggtgaagaaggaccttgcactgcctaccgagctccctcatgcctgcaatttaaataccgaggtgtgttctgagagccccaggtccttggggcacgggcctccagggccctgtaaggtggactctggcctcgaaggggggcccaggtctgaggggtccagctctggcagggggtgtctaagccacgtccaaatggtggacagtagctccaacagtgacatgacagagggagggcctgtgtgtgtggtgtgtgtgtgtgtgctgtgtgtgcacgcacgtgcatgtatatggtgtgtgtagaactgacacgcttgaagtccctgtcccgtgacccaccctcaggtacttgctgttgggttttcctatgattttgatgtgtcctgacccagcatatggatgccctccccttggagggcccagcctgcaaaccccatctgataccacacatgcctatgtcctgcaggcttctagtgacccttgcaagccgggtgaggctggtcccagtctctgtgcagatcttggccatgtctccacagccagctccccccaagcagtggccctggccctaccccagcctcctcagaacaggggtgaccactgcaggggagactgcccctaacctgtgtctttgtgtccccagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacatttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagc

SEQ ID NO: 207 - DNA, 4706 bp, Homo sapiens
cgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtctcagcaggcgccacctcctctgtgccagcagctttagagaaggctttaatccccaggacggaggcagggtgctctggtttaaggccgagctagcgattcccctgatgcaacctgtcaggttcactatctttaaaatgggaagaggaacaatctctcttttcctttaaggatgtgataggatcagataaagggcttcggaataagggagttctgtgagtgcacaggctcattcactatcattctcctcctctgttagggaggagaatggtggctggagtccccagcaatgaggacgaagagcagtgtgggaatggctagacctgtttttgtttgtttgtttttaacagaatagtaaactcggagctgcatagaaccttattcagtgcctccttttacagatgagggttgaaactcggagaagtgaaggttaaccctaaccttttacccaaagacttgcagtttttgtgtcctctgattaaataagtggggagagggtgcttttcctagatcaggcaaggggaggtgtgcttttttccaagacctatgggaggagtagaatacaggccgggcgtggtggctcacgactgtaattccagcactttgggaagccgaggcgggtggatcacttgaagtcaggagttcgagaccagcctggccaacatggtgaaagcccgtctctattaaaaatacaaaattagctgggcacgcctgtagtcccagctactcaagaggctgaggcaggaaaatcacttgagcatggtaggcggagattgcagtgagccgagatcgcgccactgcactgcagcctgggtgacagggccagactctgtctccaaaaaaagaaaaaaagaatgagaacatacacattctgaggcactgtagccaggtacatggagctgcaggcagtggtggctgtgaccagggagaaggcaagtcagtagtgcagtcaattctttctccttcagggcgaggactctgcctatccctgtgaaatgcctatgctttcatctatgtttggtctcttctcccccgtctcccctcaggtcagtgaagtttaacaagggctatactgctcttagccagagtccagatgaaaacctggtgtccctcgactctgacaggtgagtgctccccttggaaatacccccttgggaagcaacttggctgggactgaagatcgcctgatgcctttgcttgttccctgtctcctccaaggcccttcatgtacattccagggccgttctcttctgaacaatatcccttcccaggatggcttggttagaagactcataggtaatcgtgctgctctagaattcggagcaccaatgtccgggggatcatcctgccctgttatgtttgcattgttagtgagagtgaccctgtccctgccagaaccaattgagggaaccagtattattcaaggcctgttcggacttgagttctgttgtgtgtggcctttgcttcaaaagtcttccagatgcccttgcatgctctccgcctgatgatttacagctgtgcaccacaggtacctcccggaactgactgttttcctcttctcctagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacgtctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 208 - DNA, 2127 bp, Homo sapiens
aagtcatgtttatatattgctgcaaatactcggaatggggatctcttgttccctgcttaagaccacatcacattacttggttttgtacgctagtggctgaaccaaaaaaagtaggagatgattttttttcttttttcttaaagcagtagcttttgaaccttgaccatgctttctaaccagctgaggggcttttgaaaaagagggtgccttactgtgccccagaccaggacaatcagtatttctggggaatggagcctggcacacacacatttcttaaagctcccttggcaattctgaggagtggattacatgttgtatgtagctcgtaacgaaagaaatcttgtctttgctctcagacccccatttcttactcatctcatgagctccttcgagatccagaaacagttgcatatttcattagtaaatcagttccagagtcacattttatttcacaagttagtccattaaaagtttcctgcagtgaggaaatagccagaaagaacactccacccctcctcctttttataactatagggtctggctcgacagagcaggagcatcgccatcttggacaagcccctcattctaaagttcaccttaataaaaaactgcctaaattcaaactgcatcagcctaatggctaaggtcagcatgaccataaaccacaaataacatctccaaccggaaacattcgaaactcctcctcgaccagagacatgctagtcccgagataacccccctccagcagggaggatgccagtctcgggataacctctctctggccagaaagatgcctgccccaagataaacttgcctcctcccagagatattccaaccctgccataaaacttctccctcaaacaggaacattccaaaattctgataatctccctcaccctaaaaccaatatatactcctagtctgtaagagaaagcgctcttgaccaaaattcaccaggagtgcctcccaggttttaactaaagaaaacctctctttaactgccaaaaaaaaaaagggaaaaaaaaaagctttctgcagtggctttcagcgggcccagcatggcagcagcacctgagaacctgttggagatgcacactcttggaccccaccctggcctctgagtaagacactggaagggcaggccccggtctgtgcacacaagtcctcagggagattctgactgatgcatgccagattttgagaactgctgatatactccaggcacatcgcatgctgggatctagatacaccaagggaacaaaataactgcacttgtcctctggggaccgacttaccttttggaagggctgagaaagagagacacatacaagatcactccctgtaatgcaatgttttataacagatgtgatttgggatttcagtgggagcccaaaagagggactgactaattcagcctctgtgacaaggggagtttctcagaaacagaatgcttagctgggcctccaggcacagggacaggaatgaggaaatacttgtaggccctgtgctccttcagcaaaaccctcagtttcttgttatttttataaatgcaaacatcttattaaagtagatgctaaggcattagaatttcctgctttatttttctaaatgaccatgaggaaacctggaatgtcaaaggtaaagtgcaacacattctgcatttaaaaattaaaatgatcctttttaaaagtagcaaccagatgtgaaaaattggactggagtccaggttatagttgatagctttaactttctccccaacagcaacagcacaattttccctaaaatgtgttatgaataagtaaaatgactacttcacatcctttaactcttcctacagaaatctaagagagaaatgaaacaaaagtttgcacagttctagacacgataaatacatgtgaaatcacacaactcagaaaatgtcccttaaattaattgagccattggtacttgtgaattagaagagacatctatgttctgatccactgttgaaagctgtacaatgttacctatttatttgcagacatcctttggaaacaaataggtagatttgcaacaaataaagagtggagtacagctgctgacattaccttgtatattcatgcctttatgtaaaaaaaaaaaaaaaaa

SEQ ID NO: 209 - DNA, 2260 bp, Homo sapiens
acttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgcgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttctggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccatgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagactagaggagcaggagaaggagcaggtcatgctcgtggcccatctggaagagcagctccgagagaagcaggagatgatccagctcctgcggcgtggggaggtacagtgggtggaagaggagaagagggacctggaaggcattcgggaatccctcctgcgggtgaaggaggctcgtgccggaggggatgaagatggcgaggagttagaaaaggctcaactgcgtttcttcgaattcaagagaaggcagcttgtcaagctagtgaacttggagaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaaaaaaaaaaaaaaaa

SEQ ID NO: 210 - DNA, 1986 bp, Homo sapiens
gttttctcatttgcaaccacccatgctggcatgaaagaaagtgaagctgctgggttgaactccatcttctgggggacatttgcagcctgcaggggcctggcaatcttttttgctacctgtttacagcctggaaccatgattgtgttgagcaacattggcagcctgacttcatctttatttctggtgctttttgacaagaacccaatttgtctctggatagcaacttcagtgtatggggcttcaatggcaaccacatttccgagtggtgtttcttggattgagcagtacacgaccatccatgggaaatctgcagcattttttgtaattggtgcttccctgggagaaatggctattcctgcagtcattggaattcttcaaggaaaataccctgatttgcctgtagttctgtatacctctttgggagcatcaatagctactggtattttatttcctgtgctatataaattagccacttcacctcttgatcgccagcgaaaagaagacagaaagagtgaggaccagaaagctctgctctctagctccgggctaaatgaatatgaggaagagaatgaagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatctttgaataactgccacttctaaggacgccattcagagcagagcattagcagaatttcaccatgctttggggattaaaatttttaggtccatattatagcaaatgctaaaaatttttgaaatgttctgtaattcccagagtcttccataaataaccaaatggtctcatacacgtacaataggatcttgttataacgctatcatttgacatgtgactgattaggaaatattttatggtctccacccctcagagcacccaaagaaggcattgtttttgagaaggggggtattctcagaatgagaccatgtaggagttgaattgattggttgaacaaattatcaggtatcaatatttttccaggaaagttgaggagaatagtttcataaaagagaaatgggccgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagaaaaaaaaaaaaaaaaaaaaaaaaaaaaaaaa

SEQ ID NO: 211 - DNA, 1767 bp, Homo sapiens
tggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggtttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgtcctactgtgccagacactatcttgaatgcttttatatgttcaggttcaaaaccgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaaaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctggaaaggtaggcaaaggttagatcttagactgtcttgtatttttctcattcctgttgattacctacctcaaaattgaatatgtttttcctcctgcctaacacaaaactacccaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaaaaaaaaaaaaaaaaaa

SEQ ID NO: 212 - DNA, 2609 bp, Homo sapiens
tacattgggtctactgcacaaattacagggctccaagtgtcttatgagagcaggacttgggctgaccatgtctctctgccctcacccatgctctgctctgatttcaggtcctaagtgtgaacgtgaagtccccagccctgctgctgagccagttgctgccctacatggagaacaggtatggcagggcgggggtggggaccagtcggagttggggacctgaggtgggcacagaaatacagtcggtagcacagccagtagtgggtagaggacagaagaggtctgggatctccacatccctcatcttcttgtcctgcctccccatctgtgtggctgccattcccaattccagtggctgcaggatgagagtagtattccaggggcccaggcatagcctccttggccttgacatcagcaggtttgggacaaggctatgctttaactccttgaccttgtgggctggtcattgtcaccttacctgctctctgttcttaccaacttaaaaccaatgacagggttagccccattcctctccataggaaaaagcctgtcccagacctctcctcatgcctgcgcttggtctccagggaccctgcctgtgttccaggtcctgcagatctgactgtacccctcacagacacacccttaggaactggccaggggctgtcttcagtagaaggaaagtccctgactgtcacttctggtctcccttaccccatctgctccttagaggttgctcattgataggcactcaccatcagccttgggtgcctcttcacaaagcccaccctgccctctccttcaagcccctggcaagagaggaagcagaagataagggttctgagcatggacatcgtatttatgagaaataggcatggaatcctagctctgccgtgtattggctggtactaaacctttctgagcctcagttttctgaactctgagatggggacagtaataggacctgtgttgcttctgtgagggttgcatcatttaatgaactcatgatagtgtcaccatcagtggtaagctcttagcttcagcttctcttatgtttgtcttgtctcaggaggggtgctgtcatcctggtctcttccattgcagcttataatccagtagtggtaagtgcttggtccttgtgctcctgagtggtatagggtgaggggcaactttgttcttttcctcagagccttacagacaaagtgcctgggacagacccccaccatcctcctgctgccctgggctgagcttgtctccatgtgggtgggagggctgctgggcctgtgagatccctgtaggtgagaaatccaactgatgctttcccccactctcccatatcctaatcactctgtcaattcccttcccaggcgctgggtgtctacaatgtcagcaagacagcgctgctgggtctcactagaacactggcattggagctggcccccaaggacatccgggtaaactgcgtggttccaggaactatcaaaactgacttcagcaaagtggtgaggattgggtgtgtcttccatctcccagtctggctcagtgggaacccttcccagtgaataagggatcaaggggtgactgaatccttaggtcagcatgcctatgactgaggtcctcattgttctctgaactcagccatggtgcagtccatccatcctgaaaagatgctccttcttttgagaagggcaaagctgccctaggtgttctgcctggtggccttcccggggccctgcccatcttgttttagtagcactgactccttcatttcttccctttgcccagtttcatgggaatgagtctctctggaagaacttcaaggaacatcatcagctgcagaggcaagtggggtttggagatttggtggtccatgtgtggctaggcaggggcagttgagtctattgcaagagcagacccctccctgtcatctggccattgtttttgctgaaatctggagtccacatggccctggagggtgcaagtagccctgctgcatccaccttgttccccatggagcccactcccacctgtcatccgtgagccccagagcagcagaatcagagtacgagatgcttgacactgtgtccttcttccatccaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctgaggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaaaaaaaaaaaaaaaa

SEQ ID NO: 213 - DNA, 1675 bp, Homo sapiens
gcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcaaaaaaaaaaaaaaaaa

SEQ ID NO: 214 - DNA, 1863 bp, Homo sapiens
gagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaaaaaaaaaaaaaaaaaaaaaaaaaaaaaaa

SEQ ID NO: 215 - DNA, 2993 bp, Homo sapiens
gtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatatgttgactgttgtatgtttggactaatgttgctttaaagaaaatctttccaacatgcagacaaaagctttgagtgcccctattacagcagtaccgaagatgttagttaatagatattttagtggataatctgtcatctgacatccagtataagttacagccttcgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcagttaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaagaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtaacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaaaaaaaaaaaaaaaaaaaaaaa

SEQ ID NO: 216 - DNA, 1667 bp, Homo sapiens
ctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggtggaaagacactgcatacgtttgtattattagttagaaggcatgaagacttttttccctgcttggggagtgtcataagttattgttttgcatatctactgcatgccaagcactttctgcaccatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaaaaaaaaaaaaaaaaa

SEQ ID NO: 217 - DNA, 1198 bp, Homo sapiens
aaaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaggcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataactttaaactgcaaaaaaaaaaaaaaaaaaaaaaa

SEQ ID NO: 218 - DNA, 2504 bp, Homo sapiens
gattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccagataccggggagaccacgacgctgcctcctgggcgccatgagttcctgtccagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcacagccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctgggctggaggctgggggccttgccggagcggcctgaggctcctcctgagtactcggaggtggtagccgacactgaggaggcagccttggggcagagccccttcccgcttccgcaggaccccgacatgagccttgaagacccgttcttcgcctacatccaagagttccgctaccgcccgccacccctgtactctgaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagtgaagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgggaaaaaaaaaaaaaaa

SEQ ID NO: 219 - DNA, 3106 bp, Homo sapiens
cggccgcggcccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatgg

SEQ ID NO: 220 - DNA, 1884 bp, Homo sapiens
ttcaacctgaccctcaaggagatccacttcctcaagtggctggacatctactgcccccacgtccccttcattttcaaaggcgacgatgacgtcttcgtcaaccccaccaacctgctagaatttctggctgaccggcagccacaggaaaacctgttcgtgggcgatgtcctgcagcacgctcggcccattcgcaggaaagacaacaaatactacatcccgggggccctgtacggcaaggccagctatccgccgtatgcaggcggcggtggcttcctcatggccggcagcctggcccggcgcctgcaccatgcctgcgacaccctggagctctacccgatcgacgacgtctttctgggcatgtgcctggaggtgctgggcgtgcagcccacggcccacgagggcttcaagactttcggcatctcccggaaccgcaacagccggtttggccctggaagtggacattcctctattactgtgaagttttatttatgaagaatttggagggagaaggctccaggcttcaggagggggtggtgtcctccctggccctcctcccttccctcccctcattccagctgcctcccctcagcacccccacgcccctcacagcccagccccctccagagccctgccccaccgcaccctgcttctccagggcctagcagaccagcatctgccccggtgaagggatggatcagctgtgggggtgggtgcagaacgttgccacctcctacctcagcgggagtcacctaggaaagatggagggattgacactattttctcaataaaatgggactttttttttttttttttttttttttttttggtgtgaaacttcctgttcccagctgcatcagagagcctgtctggggccaaggttgccagagatttctgaagacacagcttgttccttgttcttggctggtgggtgcacaaggacttctggaagggatttagacggggctgagtgctaggattaaagtggggatgggagtacggcaacagaaaaacctgggagctagcaatgcacccagcccttgactgtgccctggtggacagccgagctgtggctctagcgtgagccagtgccttcctgtccctgccaagggtgaggccagagttggccccgaggctaatgtttcagtgggtgagattaggtcggccgtacagaggccggtgggctccctgacatcccttccaggcaacctgaaagcactgaaatagcttatggccctgtgccagggaccttggcccaagctgctgacctccagggtggggagggagctacccccaggagaagagtcactcagacagcagtatgagcaagccagccagcagctccgtgcctgcacccagctcaggggaatcccagggggttcagatgcccaggaaggaaaaggggacagcgctactgctatggaatgagaccaccacttctcctgttgtccttcccagcttctccccaacctccccttttccctagtttataagacaggagaaaagggagaaagcaaaaagctggaaagaaacagaagtaagataaatagctagacgaccttggcgccaccacctggccctggtggttaaaatgataataatattaacccctgaccaaaacgactggtgttatctgtaaatcccagacattgtgtgagaaagcaccgtaaaactttttgtcctattagctgatgtgtgtagcccccagtcacgttcctcacgcttacttgatctattatgaccctttcacgtggaccccttagagttgtaagctcttaaaagggctaggaatttctttttcggggagctcggctcttaagacgcgagtctgccgacgctcccggccgaataaaaacctcttccttctttaaaaaaaaaaaaaaaaaa

SEQ ID NO: 221 - DNA, 2570 bp, Homo sapiens
attaaaatgagaaatacataagatgataaataaaatgaaggtgaaggtattccagatctaccgaaaagattttcagtatcacagattattcataagaaattgagaaaaggaacaatcagaagttgcaaaagatggtatagccgaatataatggaaataggaaaaattagtcgaaaataaaggttgatttagaaatgaagaaaatgaatatatttcttaatacaaaataagtgggaaatgagaagttataccaataaaaagcatttacaaatttaggggatattgtaacccagtataattttctgacaggttggactttgaccctaatggacttactggtgaactttttcaaatgtttaaataatgtctatccatgtatcatgaaggacagtatgcttcaaattgtcttttgaggcagacatgttctcagtactaaaagacatttttagaaggattttattctcaacagatgcaaaatgcaaaataaaatattgacaaacaatacagcaacaaataatttactatcactcaggattataaggctggtgttaagcagaacagccattaaatcagcatcaaaagaacaaatagtaaaatccaaagtattaattacagataacttttcaaaaattcatcattcacccttgatttaattatttctctggcaattatttaatagacttctcggagtctgttaagtacttaaaccaagaactaccattattcctactgggaaaacataaacatttctcaagtggaaagtaaacagtgttggcactatttttatatatggttaaagagacctgtcattgcaataaaagccagcattcacaaaatgaggaagataaggaaagtagcataaatattttctattaacatggctttacaactgctaaaacttatagtataaaaatgtactaacaaagactaattcaagaagttgcaggatacacaatttttaaaaatctcatttctacatcttagcagtgacaaactgcaatttaaaaagtgtgtttggttattaatatatatgagacttttaaagaaagttatataactacatagagataaattaagaaagatgcctaaatagaagcaagtttaaagagctatatttttaaacatgaacaaactcccatgggagccatgccagtgtagtggaaaagtagtacatggggagatggggagtttttttgaaaaccagaattacagttctcatttcactacttaccagttgtatactcttgggaaagtcactcctagtatctatttcaccatctacagaagagaaatacttcacagaattattgtggggattaagttagataatgtgttttaaaatataaagctacatccaaagaaatgccaatatgtgacattagtatgaaatttactacagttccatttaacattccaactggttgctgtgtggaatatggcataattgtaataaattatttaggaaagcaagcaaagatgtaagtttttttaatttagggggaaaaaatgggagccttgctctccaaatccttaaaacatgctattaagcaacctttctgaatattctgtggtgccaagtagaaagtttaactgaaattaataagccaatggaaagaaagaaatattaataactgctggtggaaagactagctagatgtcagtgtggaaagattagatccactttacatgtgatattccaaatgaattaaaatgttaagtataaaaagaaaaatactacaagtctcacaccaatagtggtataaaggaacttcatggcaattggcaaggtagatcaactaagagaaaaagttttaaatgtgtagtaaataggaaaaagacaaaacaagatggaatttaaaagaagctatttgcattacacatggatgcactcagtttttgtaaaactatatgcatatccataggggtttgtactcttaggcaaatttataaagcgatcgtgtataaatgatataaaaaatcaatttgaatggtattcaaatttcctaatattaaaaatgcaactttgacttagttcatgctattgtattagcaaaactgttttaattgcatgtgtccttatagcagcagcattgtgtattagtagccttttaagagaactgtgtagaagactataaaaagggctttataactgatcttttgacatactcactttgagtggcatatgcccaggaaaatatttaaaagaaagaaaagctatttgtacaaagttttctagcagttccactcagataactttaagggggaaaaaagcccaacgattggaaatggttaagtaaattttggtgtattgctagtgctatcacagaatgttatatagccattcaataatattgatatatgtcaaattgtatgcaaaaaagtgagattcaaaaatgttaataagaacataaattgtgtttactgatacatgtgaaaatttaggtctacattgaaaagaatcagaagataacatgtaattcagtttaacattaggggttctttatttttcttctgttaaatattgatgtatgcaataaaaaataaaagattaattggtaaagtggtttactg

SEQ ID NO: 222 - DNA, 1229 bp, Homo sapiens
gtcgtggctcgttccattctcggcggtggtacctgctcccggtggccctgaggacgtgtgggccaggggcggccccgaaattaggaagcggagggggagcagtctgcaggtctgcggggctaagtgtcgcggcggcgcacctcgcgtcaagaatccggaggaggagactgcaaggataggcccaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggtgtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagat

SEQ ID NO: 223 - DNA, 2132 bp, Homo sapiens
catgtctggagaccattttcaacctgaatttatctctgatgccagtccccaagatgagccattggttgcttattctttggggtcacccaagatggcagcactgaaggccacatggctggggttttctataccttgggattacatgttatacaaaacagctgactgacaatgcagaatgagggaagggacacctccaaattccttcagcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtccgagaatggaattctctgtaagcctagttgctgaaatttcctgctgtaaccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatatggggagatgtaataaaacaatattaacttggtttcttgtttttgctgtatttagagattaaataattctaagatgatcactttgcaaaattatgcttatggctggcatggaaatagaaatactcaattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgatcgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataatgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaattagttaatatacctaaagtacatagaacactgcctgcacatagtaaaagaattataagtgtgaggtagttggtaaaattatgtagttggatatactaccgaacaatatctaatctctttttagggaaataaagtttgtgcatatatataatcccgaaacatg

SEQ ID NO: 224 - DNA, 1149 bp, Homo sapiens
tattagaagttggatttctggtgaaagggtttgagtgtttttgaggctttggcacagaatacccagctggtcccagaaaggtggttcccatttacctgcccgaaggtaattcacccttactgatactgagtactgttttctaaaagaacattaaaaattggataggttaaaaacaggtgaatacatttttttagttgcatttttttggttacccgtgagagtgaacatgttgccatgtgtttgctgacctcctaaatggtctatttgctcctacctttgtaccccaaaagtctgctctcaagatggtagccagaatgatcctttttgagacataagtcaaaatttcactcttctccttaaagctctgcaatggttctcaggttaaaggccaaagtcctgttcaaggcctccagggtcctcaccacttggtcccttgctctttctgttctagccaacttggccttctcctgcccctccgccgcaccatggcaatttcccctgctctgtgtggtcaactacctgaatctgttcaaagctttgctcaaatgtctccttcctgatgagacctccccagcccctgagctccccatgccccactcctgatcgccttacttaacccttctttttcttttttgccagtagtacttatcaccgtctaaaatacttcataatttacttgtttattgtttgcccctctccaatagaatgtaagctccttggggcagggacctttgtcctttgtcttgttcactgctgtgtcccatgtgtaaacttgtctggcacagaagaggtgctcgataaatatttgttgagtgaatgaatggtaaattttctgttcatattctttgactattttctattgtaatgttcatctttttagtattggtttataagatgtatatttagcaccttttcatatatcactctttgtcacatattatgcaactaatttgtcatttccatcaatttttaaaatactttcttgatgcttcatttttaagctgtcagattattaatcttttctttatggtcttggactttattgttgcataaccgctgccttcaccaggaacatataaattttcaattaaatgttcttctgagattttatgatttcactttttatattaaactcttcattttgtcttc

SEQ ID NO: 225 - DNA, 1411 bp, Homo sapiens
aaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatg

SEQ ID NO: 226 - DNA, 1831 bp, Homo sapiens
agttgccgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttc

SEQ ID NO: 227 - DNA, 2453 bp, Homo sapiens
tttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatcctttaggctttttcacgagatttcctaagtggtgaaggtgacctttcccgtcgccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccattagacgctatatgtcagcgtactactcaaactgtggaatgtacgcaaactggttcagtggtattaaattcatcatctgaatctgatgacagttctctggatatgtcacttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaagtatatttatattagatcttgtgttgttatcattcagaaaagatttcggtgctttcaagcccaaaagttatat

SEQ ID NO: 228 - DNA, 1665 bp, Homo sapiens
tacaaatcattcatgaaactgaagctcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcatacacacacacacacacacacacacacacacacacacaatgattggagggctatatgatccagcattagcttcctggtgtgccaagcatgcttgatcgggaatttttttttattattattattttttagctgtacctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaacagtttcagaaacctgaatccagggccttatagttctcctcattatctatcttcttctcccttccctcgcccaagggagtgggggaaacacttttcattgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctggtttttagggtatttttagaattcattcctgagtgaggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttcttttttt

SEQ ID NO: 229 - DNA, 2328 bp, Homo sapiens
gtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaagaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgcttt

SEQ ID NO: 230 - DNA, 2593 bp, Homo sapiens
gtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaagattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaagacataccccttactggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagggcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttg

SEQ ID NO: 231 - DNA, 2635 bp, Homo sapiens
gcgctcctgctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgggtttgatatgctggtgaagaatagaacccaaggaatcattcctttggcccccatatctaaatcattgtggccttgctcagtagaatcttccatggaatattgtagaataatgtatgatatatttcctttcaaaaagccggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttaccggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaggatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattgaaatatttgaaatgc

SEQ ID NO: 232 - DNA, 2833 bp, Homo sapiens
aattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgct

SEQ ID NO: 233 - DNA, 2116 bp, Homo sapiens
tttgttatgtgcagagttctaaagccattttataatactgcagtatccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttagtttaccctgtttgtctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaaaagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcatt

SEQ ID NO: 234 - DNA, 1819 bp, Homo sapiens
gtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgcgagggaacttactttggccagcattgaccttcaaagtcagatggaacccaggacccatccaacttggctgcttcacattttcatcccctcctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagcacttaaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttc

SEQ ID NO: 235 - DNA, 2567 bp, Homo sapiens
acgtccccgccgggcccgcgcgcctcgtgcctcgcgcctcgcgcctccagccacgtccccgccccggctccggcgcgccgcggagttggctgctgggaggtgcgggactgggtgtggccggcggctctggtctcggctgtgagctgcgctctccacgccggctccgcgctccaggggctgctgagcgcccagcggacaccggcagcgcgcggtcgacgcgggcctgagctccctccagctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactccgtgggtcgaatacaaatgcgaacaagacgtacactgaggggccacctagctaaaatctatgctatgcattggggatacgattccaggctgctagtcagtgcttctcaagatggaaaattaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagttttttcccaaatggatatgccttcgccactggctctgatgatgccacttgccggctctttgaccttcgtgcagatcaagagttattattgtattctcatgacaatatcatctgtggaatcacttctgtagccttctcaaaaagtgggcgtctcttgttggctggttacgatgactttaattgtaatgtatgggacacgctaaaaggagatcgtgcaggtgtccttgctggtcatgacaaccgtgtgagctgcttaggtgtaactgatgatggcatggctgtggcaacaggctcttgggacagttttcttagaatctggaattaacagtgtcatacatatttgttctccattgatatatctggagaaatcaatgctacagcctatagctgtgaaaaaattctaccttatatttgcaggtgaagatttttctattagattatctacaaaaacaagctttcagtaaactaccaaaaaaaaagtgggggtggaggaaaaaaggcaaaggcgccttctgagatcaaaaggaccagtgtattaatttgaggggttgggttattttaaccttggtgaattgttgtgtgtactcagagtgtattttctttgtgtagaacagaatgtacacattatagcagctcgccattgtgtttgcattttttaagaagtacatttttaactttgtatacacaagaaatgtcatatttttgagttttgtaatggaagaaccaggcacagaaacagacagaaatgatactgtatgtgtgtgtatttatgtctgaagaaagtccccttgaattctgatatctctttgaatctaagagatcctgatagcttcatgtttaagagcattgacaggtggggcacctctgaggggagttcattgtttctcatgcatcatttgccatatactattaatcaaagtgcttgcttgcagtcctttgaggggacagataatctgaaggccagagattagagatttcactgatattttggacatacataagaaacatcattataattaataaaaagtaggtaatagcatataaatggttcttgacattttaaaagcctggttatgatcagttgacactttgagtacccccctaaatagctggactttccttttcatttcatatttggaactaagtttgtagcgtatactcatctttcagaagtttggtaaacattgggattgtccctgcatctgaacatctttcccagtgctatcagtatacatctagagaggaaatgcaatgtgacagtgttacatttggagagaagtgtgaaatctaaccaatcgctagcacatatttgttgtaacacggtggtttatttcatgtttgcatactataaaatctgaattgatgtgaaatatctgtgcctttaaatttcttaaacctttaagctttttgttctgttttgcaacattttgtagtatttcttcccttccttagcacaaaatactggtttctaagtggttttgcttcaaaggatgtctagatgtaagtgattccacttaaagccaaaataaaaattcctaaagcagttcttaaaggagttagagagctatattaaacagtttttctgtggt

SEQ ID NO: 236 - DNA, 1997 bp, Homo sapiens
ctacaatttttggactcaagcaaaaagccagattttttggaaccaactgaggaattctgtacacaaagcttcagcaaacacttagagaaaacaaacaaacaaacaaactgggtccttggaaacagttctggcacacaggcagaacactggaggccacctcaaaggacagaggccatgctttcgcatttggaatgtggctctgccacacagctcactcctatggtggggtcagaggtcagaacacaaaccacccatgtgggctctgctccctcccaacactctgtgttcccacagggcttctctgcgggcagccaggcacctgtcaggcttgggcaggggcctgctgagaatctgtgaatgcagaggggagggctcatggccaggattccagccagagatgaatttccatgctctgggccagggctctgtgccggcccctcatgaggtggctggctgcattatggggagatgctgcccacggcggagatggtggcagtggctgtgaagaacagaggtacctgaattctgtgtcctcagctgtcactttccggtgagacaagtggagcagggcctttgatcactgtggtcacagacctggtactgggttttgcccttgtgtgctcaaacatttctaaggtgtcccaagccctggaaatagggaagggaagggtggaggcttggatctgaggtcttgctgtccactccctgcctgcctgcccgcatctcaggcatggccaacagcagcccgttgaggggggcttgtctggacagttgcgtgtgatggtgttgagccatcacagggcagaggtcacttgtgtcacccccatagtcattgggttgcaggccatggaggagggacctccactccatggggcctattctccattaaggtggaagtgtccactgtgggcctagcacagtgcaggaaccaggccagggggtctatctcatacctctggggacaggaaaggtagaggatgaggaggttggacgtggtggtggctttgccttggatattcctcttcctctatcaaggccttctcttcttctctgtgtcccacaactctggcctcatcgccctgggactcccatctgctaagatagtggctttggaggttctggaagggcttagtgaggaggccagaagtatcagggaaagttgctggtgatggggtgggcggtgtcagaagcagccactgttttcccctcttcagacactgagagattaatcagggaatgaaatccaggtggaaattatttattgtgaagcagacgactgtctgtcctgtttatgacaaacccaaatgagaattggagggactaccagtaagtggtctcttcatgctctccccatcccagtttttaggatgaaatttagagcctggccttttgtgttgcttgcaccaaatctgtatgtctcaggtgaaactcactgttccatgagtggtcatcctttttttttttttttttggaaccagcccctttcaccctttcatccgtcttttttttttaggaaaataacccttcttgcttcagcacttctccctggtccttgctgaaagacagagataaaaatccattctctgagccttgcttggttgtcagaggccatgagaggtgccagttataggtggatgtgccaagatgctggtgaacttggtcttcagctatacccaggctcagaaagggcaagagccatgctgcagcgtaggtgactttggaggtgcacttggggcccagggctttgagtgttgcgggtgtgcctgtccctccagatagtgctctgtttctctctgttgtccccctgcctggtcctctggggccactgtgctttctgctgtgtgcatttataaatgatgtgtattttatatagacctgcttgcattggctgatgctcctctaattccctgagtttgattcaaccacccttgggttgttttgctatggccttagcctttgaaaatattttaaaataaaaaacttgatttttctagtgt

SEQ ID NO: 237 - DNA, 1913 bp, Homo sapiens
gttttgtgtggacataagttttcagttcatttgagtaaatacccaggagtgtgattactggatcttatggtaagatatgtttatgtttgtaacaagattgccaaactgtcttccaaagtggacatccagatgcataaaaatgaatctagatattttgcatttcctgtaccattttgtattctccactagcaatggatgagagttcctgttactccacattttcttcagcatttgttgttggtgttttggatttgggccattctaataggtgtgtagtggcatgcctttcttgttttaacttgaaattccctaatgacatgagtttgaacagtttttcatacgcttacttgccatctgtttatctttggtgtgaggtatctgttcaggtatttcacccattttataatcaggttgttcattttctttagttttaatggttcatcgtatatttttgataacagttctttatcaggtacatcttttgcaaatattttctccaaggctgttgcctgccttgttctcttgacattgtcttgcagagcaaaaaaaatctaggctgcagttacagatttggaagttaagagcatattggtgctattgggagccgtaaaactgcataagataaccaaaacagtatatgtaggtagaaaagagaagagtgtaaggtcttagctctggaggactggtgatatttaaagcttagggtgataaggaataggaatagagagtgagaacgaggggccaggaaatgtaggaaagctaacaaagtatgttattctaggaatgaaagagaaagtgtatcaaggaggatgtgattggctgtgtcaaatgttgctggaccagtcaaataatatgaagattgagaaatgatcattgggtgtagtgatgaggtcattggtgactttggataagagctgtttcagtggagtaatgggaggaaatgcctgttgggaatgagttcaagtaacaacagaggagagaaactgaagatagcagatgtagataagatttccaaggagttttgctgtcaaggaaagatgattgagatggaaactcgaagggagagagaaatagagattttaaaaaataataataaagttgggagaaagggcattgttggattcttattggcatcactcaccagagaaggaaaaatggatgatgattcaagacagtggaagagacagagagtgtcggtcagttgctagcctctaatatgatttgtttaaattagagtggactcagccctgcaactgctcatgtcccttcctgaccccttcccatcttgccgtatgttttgactaacagatggtacatttatgagaatgaaaagaggcccctaatccagacaggtagccaacactacctggattttaggactggattttagccttcacttgtcctaaactaggtgtctttgggtacagcaaagtaatcatactaccatagcttctctgcttagtctactccaagacaataggaaaagttatttactatcctgcaatagttaaatgtacactttgtcctatagttaaatgtacactttgtccgatggcaaatagcatgataagtgggaagagagcacatttaagaactaagaatttggtgtgggaatccaagctcttctatcaactggcagtaaaatatatttgaggagagtttaaggcgtatgagtcgtcttaccaacaagtaattatgagtttagattttatttgaactatctctcttgtttgtattttataaagtaatggtgtgttaagcgcagtgcaccaaaatgtaactaagacttagtagcacctaggactcagatcttggtttttcttacaacattcgcactgaaaggaaccctggctctttggaaaaatggctgattccaaggatgggattccttatgccaaaggaaggaaatgctt

SEQ ID NO: 238 - DNA, 2714 bp, Homo sapiens
atctgcaagggggaaacaggattttggcagcaatcctttcattactaaagcttcctttcttttcgggtacagtgaaaagagccaaggctgtgtgaccccctcatcacttagccaggcgtatggtcctggtttctgaggctgccagaaagcatcttagcaatttgtgtttggaaggtccatgcctgactattctaggctggaggttcctaaagagtaacaagaggaagagaaacaagaatctctgacacttgttgagaatagagcacagtcccatttgtttgaaaagagacaccaggcagccatgtttatgtgccagaaatgcattccacctcaaggaggacttaatttatggacccgtgtgtgccaggctgagctgggcaagatctttctcaggacaaactctgccatgcagctaaaagcctggaaactaaaggatttcatgtagtaaactatcttccaacccctgtaggcatcagaccacaggatgaggtttcagaaggtcataaggcagaatagttaagcctacagggcttacagtctgacagacctgggttcagttcttgggtcttcatcactagttttgtgacttcgggaagatgactcccggagcctcagtgagcctcagttacttcatatgtaaatgaagtaatactatctacttcacaaggctgttgaaaggattaaatggagaatgggtgtaaaacccttagtgcagtgccgtgcacacaccgtagatgccgaacgtgtgatgttggcactacacaatgtgtaatcccaatcaggcagagctaggcaggcaaatctaatccaggatctttgtaaggggactgagaaccagagactggagaaagccagtgtaaacaccatgagcaaaggagcaagagaaggggcattgtgtaagtaggagatggagcttggacttactaagtggatcagggtagaagaatccagtcaggaccaagggaggagagtccaggaaaatgccatgagcagctctgtagcatgaccttgttgggctgggttaaagtagggtctgccaccagtcatgtgacagaaaggtacctcatgcacttcctccttcccccagaaatcagcctccaggagtgaggaatgagcccagaatgagagtttagagtgctccagagcctttgttagaggtgccctccgacattcagaaaaccaggattccagagacctgggtttgagtcctgactttgcagcatactaactgtgtgatcttgaaccaacatattttcacctaatgaggctgacaatcttccctacttcacaaaatagttatgagagtcaaataaaagtacattttagaaagtgaaatgctgtggacatttaaggtggagccactgtgagagtctagggggacagatggtagtcgtctcagaatgaaacgaatacacccctctcagagccctttccaaggatcccctccttctttcagctccttccctccacctcaatacacactcctgtcccaggaacctaacctcatctagaaataccagggccagcatgccttacacctagaggtttggttggcttcagagaaacttctggaggctaaaagcagccaagaagaatcagccactacatgctgggcctggatgaacagagcagtgagctgtgatggggctggggctggggcccaggaggagcaggcaggagagtttgtatgcaccgtgattcaaatattataacaaaaatcatcgatcatgtgttaggcactttacagttcccaaagcactttcccatccatgccctgatggtctttgacacaacactgtggtgtgggttttattatttccagtacagatgaggaagactgaggcctgcatcagtgaagcaacctatccaagactacatagagaaggcagtaaatggcagggttagtctcagaacaggggagggtctgttccccccgcagtgggcagtcctaattctgaacttcacctatctgggggtgatagaggggaacaagaggaagcctgctgaagagaaaacctaaacatctgttttgtctacgtatgacttcctctgcttgtgggagagaaggaaggaaaggaacacattgttgtcagccccacaaccccaacagaattaaaccctggagcaggttgaacagcagaggcttccctcagatcaaggagccaggagcagatgatctatctctgtggccacacagagagatgtcaccttatgcaatttgcatatcatattcaattcccccaactgctctttctaatttattcaactggggaccaggctggtctcatgccaacctaggagatgtaccatagcagtatgagcagaattcctcaggaggaacaattagcaaaaactgcagttgcctctcgataggcctgagcagagagaggaacaatagctctcacgtctctcctcatcagattctaactaagcagatgttctcatgcttttttcttcttcctatgttctgtatactgacacctcttctcagtggcatatgaaatatgaaatgtcatgtgttgtgagtttgtatgaatataaaggaatatatatacacagtagcaaaagagaagatctcatttacaaatatctatggtgtttccttgttctgtgttgatctgttttattgatacaaactgaattttcttaatgtatcttctatctctattatagtggcaatgatggtatatgcattaaagttcttctgaattgtg

SEQ ID NO: 239 - DNA, 1984 bp, Homo sapiens
ttctgatgaatgtgtgaaagagttgattatttcaacagtattggttaagtcacaacgacgaagtgctgagaaggttatgggtaccaggaagaaacaaacagaagtcttaagattagaatgagaaccaaagagaatttaaccctgccattttttttttttttaacaccaagatcctaagtaattccaaatgccttagatatcaatgaaagctacacaccattgagatgggcaaaattctttctctacaaagggagtaatcaagtaaatacctgttctctttcaatggactgttgcctattgagcattgtggatgatgtgttttcagatttccaggtgaagttctgaccctacctgtttggccaaagacgtaaattgagaggaaaggccttggtcttcctgatcaaccagcatttaacgaacagtggcttaatgcagatcactcaagaggcagcatagcaatgtaaaaggaatataagtaggtgttggatgcctttttcctagaccaggaatggggaatatataacacctgtgccaccgctcttttaaggaggcattatgaatgagtgcagcattcctgtcctctgtgccaggatttggtcttagaatccatgtcagattggtgcttccagacatctattcccagtccatcagagtgaaatgaaggctatttgccatccctgccttagacagaggagtgaaagaattaagtgggtagacaccaaccaaaatgactttgaaagcagtgagctgattgagctccagttctgtggttaccagaaatactgagtgtctgtcatgtgcaagacaatgctaagaacagaatacagacataaataagtcacggcccatgaccttgaagagcttacggccttataaagaggttcactgtaattgtcttcaccagggcgtccttctcaaagatgcccacttttgtctggcacattggggctcggtggtctggtggtcccttcggtcttggccctatctgtcctttgtttttgtgatttactaacaatcatcacgaaccagttttgtttttcttttaaatttgaacatcacatcttgtgttttagttttttgctctatgatttttttctcactgcttttcagtcttctctgtacttcatttttgtgaaaaagtgaaaatcacatataatctttatttaaaaatgctcaccaaccactgcagactttggagttagggattcagcagcttgttccagtgaaaaggaggagtgaagctggggaagttagtatctaagaggggcaagctgattgcatgtgcatttatacctatgcctttaaaatattcccataaaaagtattaataaagaaatttccattccacactagtactgatgaaaaggtggttgattttgccttgtgataattatcaaaggatagtttttcatccttagattttattcacatgagagattttttttattttctctgttgacttaggaacacatcataaattcaccccaactgacacgttgctgacgtctgtacttgacataaccatttttattcatacaggaagcattaaatataaaagatggtcagttttgaagagcaaagggtgctgaaatgacttgtacggttggctggtgctttctcaaatggattgccatagttcattactagtaaagaaaaggaaaatgtgatttacgttgtcatttttcctattaaaaaaaacccttaagaatggggcacttgagctgtccctgcaatgttttcatatctagtagtcattttagggaaagtgataatctgtagaatgaatagttatgttttgatatgactgatactttctttgttaaaaggttgtattaagtcttcaatttcaagtctagcttaaaagtgtaaacattatgtgattcatttgaatacaagaatgcctatgaaatacccactataacagcattccttttgtgtttagaactatagaagaaaatgtcttcaaataaagtagttttcagtc

SEQ ID NO: 240 - DNA, 2503 bp, Homo sapiens
aacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaagcaactcaagccttaaagttcataaaagaatccatactggggagaggccctatgaatgtgatgtgtgtggaaaagcctacatctcacactcaagccttattaaccataagagtacccaccctggcaagacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaagtcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaaattgatgaacgtactattgtgatacattagttgaatggatgaaacttttttaaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatc

SEQ ID NO: 241 - DNA, 1155 bp, Homo sapiens
ggaagagccgtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcacataagccttgggtgcaagtgattcccaggtggcaaaaggcagccccatcagagatcacgggagcaacagtaagggacagagttttggggtccacttgtccctcagcatggaagccatcaccgtggtcctgcatagagtgagtctgcttctactctggcatctgagaacaagtgactctgctttagacaagcccctggagagcctggccatggagtgaggtagaaaagaagcactttttggtggtatatgctgtttctgaatttgaatctaagcattcttggtgttctga

SEQ ID NO: 242 - DNA, 2864 bp, Homo sapiens
tggcaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacagcaagataatgacatctccagcctttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaagaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgtccatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcacagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacagaactttacaaagccaagcgtattatcttttgcattaacctatttttttccatcatacatgctactagtatgtgcattagcatgatattctcatatacattgcattaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgtttttttcatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttcaaaaaaaaaaaaaa

SEQ ID NO: 243 - DNA, 1574 bp, Homo sapiens
tacagagactgagaattttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgataaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcagggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaaaaaaaaaaaaaaaaaaa

SEQ ID NO: 244 - DNA, 2561 bp, Homo sapiens
gaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaacaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggttttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttaaaaaaaaaaaaaaaaa

SEQ ID NO: 245 - DNA, 2722 bp, Homo sapiens
gggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaatccgggttgcatttaaaaaaaaaaaaaaaaa

SEQ ID NO: 246 - DNA, 2278 bp, Homo sapiens
ggggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttgcaaaaaaaaaaaaaaaaa

SEQ ID NO: 247 - DNA, 1737 bp, Homo sapiens
gcggacgcgtggggggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggttttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaaaaaaaaaaaaaaaa

SEQ ID NO: 248 - DNA, 1249 bp, Homo sapiens
gggcttagggaaggagagaccttattccaaagcatgattgcagaaggggaaagggaatattgcaaaagggagaggaaggggccttatgggaatagtgaaaaggctcagaccgaccgatggcaagatctgcaagcgtctcaaagcccgggcagagggggacttttcttttattggaagaagtaaacatggctagaaagaaccacgttcagggaatgacgttgtgcccagccttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcggccttgctggcttctccctataaaagtaaagcctttttctgccccagctctgggacacttgcagatcttaaggtctgagacttgctgattttctggttggagtgtttttttgtattgccatagtcccttccccctgaagcaatagcccctccccacctcctgcaatacgcctttccaatctttattggaggtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaaaaaaaaaaaaaaaaa

SEQ ID NO: 249 - DNA, 2058 bp, Homo sapiens
gcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctca

SEQ ID NO: 250 - DNA, 5784 bp, Homo sapiens
ctcacagacaacagccaagcacagaggaaatattagctggcagagataacgaagagaaaacactcggtgacagatgcaccatctgtcagtttctgaggagcagttttcaagaaagctgaaaatgaattgaagaagagaggggttttgtttgaaaggtacagcacagcctaaggacaattttaaacaaaaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgagtttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatgtctacctaagaaggaagcagtaaatccataatttaccttttgggcaatgctttgtgagcaaaacaaagtcacttctgccataacatcttgaatgtaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaattt

SEQ ID NO: 251 - DNA, 1865 bp, Homo sapiens
tttttttttttttttttttaagcacttgttttgggtacaaggcatttctgacattttataaacctacatttaaggggaatttttaaaggaaatgttttttcttttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtatagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaatcaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgacagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattgaaatgtatcttcaaattcagatttaataaacatgtaaagatcctctgtaaaaaaaaaaaaaaaaaaaaa

SEQ ID NO: 252 - DNA, 5957 bp, Homo sapiens
ggggatgacaaactcatttccagtctgtgaactcctggacaaagcaaactaaccactgaaaaactcgaaaatagggcaagacgacattaaccttgtgaaagtctgctttgaaaaaaggcattctgtcaagctgtgtatttttttcttgattattcaaatttatttcgttattcaaatttaattcagaaaatagctcagttggtttcagggggaatggggtgggaggggtttgggcacataaatttatgatgataattttaaatgtacgatcattaagttgtatgcctcagtactataacaggtgaatctctgtaatattgactaaacagttaaaagatattttgtaaatttcaggtccatcgcatcaatgcatgaaatattagaaaaccaaattccaaagaatcaggaatttccatttccacccaaagtatacattattatcttctagcagttgtctgttaatataaaagcagcaaaatctcagctacttatataattttctccttttatttgaaagttacacttagagattaataatatgtacagagaagcttttcctgcctactctgtttataactccgtccaacttgcccacaaacactgccctccttcaacccatctgatgtgggcaaagccactgttttcttaggcccataactcagtgcagctgttttatttttataatgccggtcaacctttttgtttgtgtgtgtgtgtgtgtgtgtgtgtgtgtgtgtgtgtgtgtgtgtgtgtgtctacgatgtgcttatttaataattgccaaaatatttagactagagtaacttccggtgggtcaattggattgtgactttcttttgtggttttttggttcttcgattgctctctgttaaatattttcataattccccccacagaatacgtgtgtatatactgcaacttaaaaactaaaagcagtactcgaatgagttgttttaatgttgtacttttatctgtttgttttatgggttctcctgctgcctaatgacctttctgtttttataactgccggaaagccgcgaagcctctcgcatggggagctaggtccccgctgcggctccgcacttgagtttattataaactctggggttctgagtaagttttgtttgaatacagcaacatgattgtctctttctattcttatcctaaaagactctgtctggcatcttttagttgtaccctcgtatctgcttctctaataaatgttatattttttctcagtattgtgtattttaagtgacttttcatgtttccaagaaaattattctgtgtaatatgaatatttaactctttcatctccagtaataggggattttctagcccaatgcttttttaaaaattctgcctcccacccctacctcctcctttaaatgatggcacctcccctgtttctgatcttgcgtgcactcagggcctgagaagtctgtgtttcttttgtttcttttctctctccttgagatgaagagcttttcacggtttattgcggaatgaatacagaacaacaggttttccttttcaccaaagattttacattgtactgctgaagagccaagagtttccttctgagagaactggaccttcatgttccttgtaccattctaggaaattgatgcatttcttttcttttcttttttttctggagttgaattctcactctgttgcccaagctgaagtgcagtggtgtgatcctggctcgctgcagcctcgacctccctgggctcaagccatccttccaactcatcttcccgaatagtcgggactacaggcgcatgccaacatgctggttaatttttttttaattttttgtagagatgaggtctggctatgttgtggcccaggctggtcttgaactcctgagctcatgcatcctccctcttcagcctctcaaagtgctgggattacaggtatgagccactgcacccaacctccgtttcctttttttttttttttgagacggagtcttgctctgttgtccaggctggagtgcagtggcccgatctcagctcactgcaacctccgcctcctgggttgaagcgattcttctgcctcagcctcccaagtagctgggattacaggcacctgccaccgcgccaggctaattgttgtatttttaatagagatgggttttcaccatgttagccaggctggtcttgaactcctgacctcgtgatctgcctgcctcaggctcccaaagtgctgggattacaggcatgagccacggcgcccagccccggcctccgtttcttactttctctcaaaactaaacttatgagaaagacgagttggggcggatggcctcatcagtctcctgtttgggcttctcttaactctgaaggaaagaccagctaaaggctagagagaaaaccgtgaaagttcctcatctcagacccgccctgtggtaaccgattgctctaagacgccccctcccatccctcccctcccactaccctcccctcccagggcggtgcagtttgtagccaagagcaaaatgcccgcctgaaacccgcgccttcctctctaacagagagtttctctttctgtttctctttgtgttgtagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacactcgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggtggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgtttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctcctcctgttttttaaacttttccaccacctgcgtccaaaaagaatgttatagcgagtgctcttaaatgttgaacctgggtgttgcttccgggccagtctgcgtggctccatgaaaagcccactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtgaaaaaaaaaaaaaaaaaaa

SEQ ID NO: 253 - DNA, 2078 bp, Homo sapiens
tgggcaattaaccaagccatagccaatgaatatgaagtccggagaaagctgctaataaaacgtttggatgtcactgtacaatcctttggctggtctgacagagctaagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgttgatgggcagggtgcctgacagaggtggtagacccaatgaaatcgaacctccacccccagagatgccaccgtggcagaagaggcaagatggcccccagcagcaaacaggaggccgagtaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaactttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctccttcctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttctgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttcaaaaaaaaaaaaaaaaaaa

SEQ ID NO: 254 - DNA, 2758 bp, Homo sapiens
gacaagccacagaacccctcttttctaaaatggagacaataatttcctacctcccaagggagcagagaggcctcgtggcacgtccgtggccagggagcccactgtcctggctggcggcgggatcgtgcgctcctctgtctcccggatgagaagccccgtttccatggtcttgacccttcctttctcccggctgtcagaactgggtctcttgattttgcccctacattatgcctctgtgggaaaaaaaaaaatcagaccaagaaatgagcctgaaattcagtgtttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcagcaggctgtggacacccttgccaccactggggactgccactgaggactccccgagcacgttgttccccgtcttctccaaggtgttgaggtgagctggggttggccccggcccaggcttctgtcccaaggagaagctgccactgacagtcatcctaccgcactgctaaagagaatgttcgcagtggtgggcggcgtgcctgtgccaacccttccagggacccggccatgggggaccttggcccaaggatgcctggggcctgccagctgtgctgcaaaggtggggggcccacaccctaaaactaacccaggccccagaccactggaggccagggcttccctgcacgggctaaggggtgttgggatatcaccccaaagtgaccttgccagtgagctgttcagcaggtagccactgccctgccatctgtgcagagccagccaccttgggggctggggttcccgctttgaggcccaccttccatactccccttgactcggctctggctgaactggggaactctcttgtggtcagcaaagcccctgccatgcaggccaggtgccattgagaattaagtgctcagagggccaggagcccaggggatgggaaagtgtgtggttttagtacgttcaaaagggacaatcgcttgcagttggtagatctagcgatctagttgggagataatggtgtttaccccatatgaagtattcaatagttctacttgtgaatttgtatttattttgagttatacttgacacagaattccttttttaaaaaaatatgtgtgtattttggaaaaaaaattcatagatgttaaaatttctgcatggttaccagtttttctcacgacactgaatttggtagcttttcccgaaaaaatcttcacagtaattttttgtctgtatatatttgagggcctttttttaaaaaaaaaaaagaaaagaaaaatataattgtttgatttttgagattaaaacaaacaaaaagagaggcattttcaaaatttcagaactttcaggagggcaagagaatatcaaacaaagatttctggaagtattttgccaaccttctggttgagctgcaagaaaatatttatggtgagaacttttctgtttcccgttattgggtttttggctggtttttgtttgttttttactatgctttggtctgtaaaaatatgcaactgaactacattcagaaggaaatattgtctacatagaatattatatgaagttggtacataattctgatgaggaaaaaaaatctttgcaattctttaagccatattgttgtttttctgtgttgttttccctggatgaaaatatcagtattaagtagacagcatattatccaagtgtttagacttattaatatgttcttgtcctgtatttatacatatgtgtattttggaaagtattgccttttttaagggaagctataattcgatacatagtgaaaaagggaatggtgacccctttgtgcctcttccactgaggataacaaacagcattgtaatccattctcttgcaccttcttcttcttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaaagaaaaaaaaaaaaaaaaaaaa

SEQ ID NO: 255 - DNA, 1340 bp, Homo sapiens
gggtacggctgcgagaagacgacagaagggtacggctgcgagaagacgacagaaggggtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaacagtaaacacccttttgaaaccaaaaaaaaaaaaaaaaaa

SEQ ID NO: 256 - DNA, 1215 bp, Homo sapiens
ggggggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtgttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattactatatagctactgcatgaagaagagttcttagtgaggcctgggtgatcagctcttcttagtattctgtgtgaccccatttgaccttttaacaaatccctaagtaaataaatagcccctcaggaaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagcaaaaaaaaaaaaaaaaaaa

SEQ ID NO: 257 - DNA, 3104 bp, Homo sapiens
ggggataagttttttttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagatgcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgcgaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggccctaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcgagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaaggctaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttccaaaaaaaaaaaaaaaaaaaa

SEQ ID NO: 258 - DNA, 1500 bp, Homo sapiens
gggggttgccgggaactgcgttccaccaaatacatctctgatggccagtgcaccagcatcagccctctgaaggagctggtgtgtgctggcgagtgcttgctcctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtataaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 259 - DNA, 2655 bp, Homo sapiens
gaaaatgtatacctggcagcaggcactgtgtatggactggagacccagctgactgagctagaagatgccgcccgctgcatccacagcggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgctaaaagcttagcctaccacactaccagtcattcccatcgctttgcaatcacaagccacaggatgagaagttctgactcactcatgccatgcccagggctatctgaaacaatgtctcattaagaatttagggttcttccatgggcttactgacagttgcccagatctgaaggggaaagggtcttgagaaagaccatcactggctcaactttagggcactgtccagagtcaacatgatgtggtttagcagtgatcacatctaaacaaagtttaggtaaatgaattatcgcagagaaaaaccacatgagaaaatttttgtactccaaatttacttcccaataaatattcagcaaagtagtaaaatgaccttaaagataaaaatgattagggaatagccttagaaaatttataggtataaaaaattcaaggacaaactgtgcatttaatggacacaagaattgactctaactccatgtctgtggtttctttgaacccatatcaaatgtatgactatttagagtgtttataagagataatggaactgaactttcactcaattaattgggcattaacaaccttcttttatgtttgttcctgatatagtctgaatcttaggaagaaggtaaaagaaaggaggcaagagaatagttatgatgaatatgtgttaagtgcctgctctgaaggaggcaatgttcttctcatttgaatccttatggcaaccttattcaataggttttcccatatttcagatttaataactgaaggccagagagattaatttgccaaagccacacctttatgctaattatgattggaatgcatcacaaaagcctaactctgttgttttcaacctctacgttattttgctgctatgtgcatttccagatctgattttctgctaacttgtgtgctatgatccactcctgatgggggtctacattaatcttccagtactccttgctgatgctgtgttatgtgtcatctaacagaaatgactcctttgaaataagtaaatctttggctttttgttctgttggtgtgattcaaagcaaaacaaacaaacaaaaacaaattttaagaacacaacaaaaaagatttgacttccgaatagaatgttttctttaagaggcatgaaaagcaactattgttgtgttacagtgttaaaaatattcagttttctttgacaaaaatgtgtactgtgtaagccttgcaaacaaaaaacaacaaaaaagaagcagcagcagcagcctgctgtgtggcatctgaacttttataaaggtttccttgtgccaaataagtgcaaagatttaatttactattaaaaaccataagcatatgttatagttccagaagaattattttgtcatcaagtgattttgatctttagtgtcaatatttatatttagattaatttttataaatgaaaatattttaatggtttaagaaaatgaggacaacaggataatatctttgatgacttctgaaagttatgcttcccttcatgttatatgcacattgccaagaattactgtcaagagaaatgataagtaaaagtcatttatgaaaataaaaaaaaaaaaaaaaa

SEQ ID NO: 260 - DNA, 3030 bp, Homo sapiens
ggttgctttgttaagttccatctaatgatcattctgacgtaagtctgtttttcttatttccttggaatgatgtctcctctggtttcagaacttcctcctctgcttcctgtatcctgaggctggcggggccagttgtctttagggcttgtgcatttttgtaaagagcttgcacgtgtggaaatcaagtaggccagtagtgggttaggggtactgagccagaagcctctacaaggaataacaggagcacaaaggaagaaggtggtattccagctggggacccaggagggaggactttgtggagaacctgatgcttgaactgagtctaaaaggtgtaaaagtgtttgttgcttctgcctccctgtctgtctggcagggtgaggtaggcgcatctagggaaatgtcaagtggcttggtgtagggtaaagtcagtgaggcccatggagaaaaacgagcaggagccacatcacatgggtgtctgataggacctgggaggcgctttccacattaccattgtcgcttcgtgatctggacacaccagaaggcgtgagactggaggcaggaagagcagccaggcttatccctaccctcaggagagctgaaaagggcaggtatggtggggccagagctcaggagagtttcggaaccactgagatcggtccttgatttgatgagaggcttgaggggagagggaggtagctaggatgccccgcaagcttctggcccagacactgggcagacaatgaaaccctttgtaacacatgaggcaataggtttggggcagatgggaggggaagcagtggtgggggcagtgagtgctgaaggtgttttaagaagcggctctgggccaggcacagtggcttatgcctgtattcctagcattttgggaggccgaggtgggagaatcacttgagcccaagaatttgagaccagcctggggaatatagtgagaccctgtccctacaaaaataaaaacaactagctgggtgtgtggtggtgcatgcctgtaggcccagctacgcgggaacatcacctgagcccaggaggttgaggttgcagtgagctacagttgcgccactgcactccagcctaggtgacagagcaagatcttgtctcaaaaaaaaaaacagctctggatgggaagggaggccagttgctttaagtaggggagatagagttaaaggaggctttgttttatttaaaggtgggacaaacttaagcatgttaataaaattcagagaagagaaagagaatgactatcagagccatgtttggaagaaaatggggtccagagcacaggaaggggacctgtgttcagagggtgcctcactgctgaggccacaggaaagaatctgtaggtggaggggaggccgaagaggggaagtttcatgcttgataattaaaattttctgagataggaatgtcatatttacctatttaagccaagtttttttagataaaaggtatggaacctgctttccccttggctagttcagcgtttgggctccggagtgctgaagatgaggactggacttcgagctggtgtgatcccagtattcagtgtcagtactcagtgacaaaataaatgagagaaacgggaataagaattgtcgcctacacaaaaataccagcaactgttaactcttcccagaagattttcattctgaatgctcctgtagctaggaaccctaaaaagtctttgaagcaactcaagttttaaaaaaggggaggaactcctggaaatctcaggatggggccaagatgtggctggagagtgtgtggtgatggagggcgtgtcttttgccgagcacactcagggcccacgggaagcccatagacttcaaggacatcaagccccaaggtggtgggattttccccaccagtacttggcagcctagggggaaggggagggcgggagaagataatggggatccctggctccaaacataggaggacacatctgtgctacagtgcgcacatgcctggatgtacactctgtctttggagacactggctaagattctctgctccatgtttggacagggtcgtgcctgatctgagataaatggacaagaacaactgaagcctgtcttctggtgcatgtgtcacctgccgataactgcatcttgtgataaagttgggtgatttacagtctccaccaaatgctaaactctggggtcttacgcctttataactccatgggccccagcaaaggttcaggctcaaaacaggtgtcaaatagataactgttgaatgattgttccccagttgcaggctctgccacctggcgttcatactgtctgtgaaaggacccagctcacctttccctctttatctcccagtccttcccaacagcgccgacacctcatggaaactgattgcaaatgtgctacttctcacttctgtgtggcccgaggaggctgggttaatgctgggcttggtaccttaagcaccctttctcccttccccatcttcattctcagaattacacctgtctgaagcaggcattttccaatgccctagatgggaatataagtgtaaggagatgtgaagcatttgcctgtgtgtcagaacattcactgaggatcctcataggcacttctagaaaccaaatccttgaagatgactaaccagaaatgcccgtcatagcactgtttacagttgcaaaaactgaagccaattgaaatgtccatcaggaggggattaaatgaattatggtacagttacaccgttgaatattttacagccattgaagatgatatatagctatattcattgacaaggaaaactcatattttttagtgaaaaaagcaggttatagaattgcatgatattcacatttatataaaactttatatatgggaaggatgttgattgaattgttaataactatggtcacctctagagatggaagtttgcattacctttaatttttaataccattttgtattgcttaaaatttgtatgtattatcgttaaaataagaaaaatcaaataaagctattttcattatgggaaaaaaaaaaaaaaaaa

SEQ ID NO: 261 - DNA, 2361 bp, Homo sapiens
gaggggacactgcacagccgctcgcccctcgactcagtcatgggagctgcagcacgcagatccaccgcaagcttcctgcacgcgcatctccggaatgctgcgctgggccctcccaccatcttcgcgtttgtgagaatttactcagaagtgagagaactgaagattcctggtgcttttgttaacacgtttctatcttattggttggtgtggaaatgttagatgtgttgttaggtttttaaatgctgtgggtggtatgattaaagggttaagtcctcacctcagcccccagcccccttttggggggtaggaagaggctgagttatctcctatttaaaacctccttggatttaagtagttcagagttaaagctaaaacaccaaatattaactctttcccccaagtgtctccaggaactggacgttggggccattcttattcagttctttctgtagctccaaggtccttaaaatgagtgagttgatcccaagaacaccccacagcaccaaccagcagggcacagtgcaagcgacttcatagatcggggtgctcgtgtaggggtccggggctcctttgaactctgggagttgtgtgcgcagtcttgggtgggagacggcaggtccctctgtcccaagaagctggtggtgccaaggccttcctctgtctccatcagtgccagcctgatcgcgttctggaagacccagtctcagactctgtgcctttaaagtccggtcctcagtgtcctttcagaatcatgttggggctgcgtttctctggggaactaagcctgtgccattccacaaggcaggcgtggacctccagccttggaagctttctttccgctcctcagcccctgacttgtaaactgtgatgccatgcagtctggagccgcgggggacgcactcggtctcattgcggaaaacacttggttccagtcgtgtggtttctcccataccctgaccaagtccacctctgccaggattgcaggagattggtgcaagacccatctcttatgcattgaccatgaccatcagcaaagcctggtggtcttgttctcatagtcactcgagaagaatatttattgtaatggaagtagattttttaaaaaaggaattggaatcatgtctttgtagaatgtgtgtgtgtgaagtcctcagctgtaaggtgctattcagtcctgtgacccttattttggaatgctcttcattactgttgctctgttttgtgacttcctgggaaaccgcctactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcgtgactcaaaccctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaaaaaaaaaaaaaaaaa

SEQ ID NO: 262 - DNA, 1284 bp, Homo sapiens
ctttcacagaaagaaagtaacaggcataattcctgttgatgaggctgggattgtttttaagaggagagataataacttcatatttttaaagtgccagtagcctaatatgtgaaacagatcagaatctgttgtgtagtaagtctgctttgttgaagaatttattatgggagtaaagataagaaggaaagagatcaccatcagaaacaagtcagccttttcatgcttttttgagcatttttggagatgattccacttctcaagttattatcatttgtgcatctcttcaatgctattgttaaatgctttagaattagaatattttgatcctttaattaaagtaagccaaacgtctaggcaaaaacagccaatcattaaactttaatagtaattcaaatatagatttctcatacagttttccatgtctgtagaaatcaaagttgtaatgttaagcagagggaaatgcgtgtgatttactaatacacttcaacgttctacttttgaaaggatactcatgtgggtggggcagagaacatagaaaaagatatgatggaaaacctgtccattttctacctgttaaccttcatcattttgtgcaggccctggaagcaaagagaggaagggaccgactgcatttatctttgaacacttgagcatcagtagtactactgagtggccaggggtcttgtctgtcaaagcaaatgataagttcactcaggccattattgactgctgaactctcttccttcccaactcttccttgaaagagaaaaaaatactttgccttcttgctctccttatcaaatgtttttgtacaaatagtgtaagcctgtttaagcaaaccaattaaaataggcactgattattttgatctgtttgtaacaaatgaatgtaagtactatttacatggtgtgcctaggaggagctgaaatcattggcactttaatccatattgtaaagatcagtatcaaaagcatagtgttcttcacctctcctcctcagcatccatctctatatacttgattaaatggaaaagtctcttttatcacctctatgtaaagttttatgggtagttatcgtcagtgtatttaaatatatcttctagtatgttttaaaggctggtcttcaatactgtggagacaaaaaataaaagagcgtatgaaaagtacgttagacttttgctggcattcaagtcatggctagtctgtgtatttaataaatgtgtgttatttatgtcgtgtttgtcaatggaaaataaagttgaatattctgaaaaaaaaaaaaaaa

SEQ ID NO: 263 - DNA, 3958 bp, Homo sapiens
ggggggagacgagcaggtccgcgacgctgctgctgtgcctgctgggctgccacgtctggaaggcggtgacaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggtgcccggccacagcctcgcgttcatttccagagaagggctctgaggttgcctgagaacaccagctacagtgacctgaccgcgtttctcacggccgccagctccccttcggaggtggacagttttccttatttgcgaggattagacggaaatggaacaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggccgccatgtcccctcccatcccaggtcccgttgtaacacaggacattaccacgtatcacacggtgtttcttttggccattttaggaggaatggctttcatacttttggttttgctgtgtctccttttatattattgcaggaggaagtgcttgaaacctcgtcagcaccacagaaaactgcagctccctgcaggactggagagttccaaaagagaccagtccacgtccatgtcacacattaacttgctgttttcacgccgagcgtcagaattccctggcccgctgtccgtcaccagccacggccgccccgaggcccccggcacgaaggaactgatgagtggagtccatttggaaatgatgtctccgggcggcgaaggggacctgcacacccccatgctcaagctctcctacagcacctcccaggaatttagctcccgggaggagctcctctcttgcaaggaagaggataaaagccagatctcctttgataacctcactccaagtgggacgctggggaaagactaccataagtcagtggaggttttttccttaaaggcaagaaaatctatggaaagagaaggctacgagtcctcgggcatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatgtatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacacccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttctttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgtcagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaaaaaaaaaaaaaaaaaaaa

SEQ ID NO: 264 - DNA, 2515 bp, Homo sapiens
agcattttccacgtgattatcaactttacagccatcatttcaatgtctgtactattccacatggtggatgaactagagtctactcatcttttattgttgggacatttaggctttttgcaaataaaaatatttatcatagcagttccttccctcccctgatggcctcataagcctgtggtcctaggacttgactctttcccaaattagggtgcccacgcttccttattccctgaccacattcttccagcaaaccctcctggagctgagtgataggcactcatggtgggaggccccatttaacaccatccatgcagcactgatttgttataggctgctgtggggggagggggtctccaaggaaacagttgaggaaacagagagtgaggtgagcaggcagctaaatacagaaactgttaagggcatcagaaacacccatgggcatgtggacagctgtagaaatagggctgcaagacacctcagctagaatctaatgacctgagagcaccaggaaaagagaagggagttgacagtgtatgcagctaggaacacatccccgtcgggggtctgctctgaggaccctctataaccctaaagcagacagtacctctcccagctcagtatgatgtgctctatgattaatctaacatgaggcgactgtgttctccatcaaaggagagactgttcctgtgtgtgtgtgttgaggggtgaggggaggggggaacaccagggagacctttaaggatggggtggcatttgagcaggacctcgaaagatgaggaggcttttgacaaagggagtccagaggcagaggacagaacatagaactagatgaagagcccttgagggcagggacggtggacctccccctccctcccagatgctggctcaggcctggtggacactggcaaatgtcgttttgaatgagtgcccccggggggagaggtggcagcatgtgggcggtggggcatttgttggggggggcggtgagtcttcaccactgctgctcttgcccctcaggtgcagtgctttgaccccaaggaggaccggtggagcctgcggtcaccagcacccttctcacagcggtgtctcgaggctgtctcccttgaggacaccatctatgtcatggggggtctcatgagcaaaatcttcacctatgatccaggcacagatgtgtggggggaggcagctgtcctccccagccctgtggtaagtggaggcttcaaggcaggagagcggaacccgcttctaaggctctggatcttggagcttgtgaatcttgtgactccatcctaggtggttttattatacatcactctctagctcatcctcacagtgatagtgaaccatgcatttcacagatgaggagactggccttagagaggttcagcacctggcccaggccaacaactaggccctgttaaggcagagcctagaaccctgcagtcccaagtgctatagctttgagtggggatttggtccaaatgaccctgtggtctctcctgccccgaaggccactgctagtaaccaatcatgaggtaagatgtggggaagggagttgctaaggtctgctctagtgatatcagagcagggaggcccaagtcctggaagctctggcccctgcaattccctgcctcccctaccttcttctccatcccctgaaactccagagactacacagatatggttggactggaggtctctgccagttctgacctttggtgaccttagaggtgagatttctggcttgagtctgagattctaagatggcggcagtcgagattattgttattggtgtgcttaccacattccaggctctatgtaaaatgctttatatgcttaacttccattaactgttaagggaaccctgtgaagaaggcactttagttcttctccctttgccgatgaggaaactgaggtccagagaggttaagtgacttgcctaacgccattcactgaataagggtcaagctagagctggaactcaggtccatccagtttcctgcctctctacagtccagattgcctgttcacagcctgtgggtcaaggttctattatctggcctggccaggcagggacagaggaagccccaggctggacctgatagttgtctttctgtttgtccacccaggaaagctgtggagtcactgtgtgtgacgggaaggtccacatccttggcgggcgggatggtcgcggagaaagcaccgataaggtcttcacctttgaccccagcagtgggcaggtggaggtccagccatccctgcagcgctgcaccagctcccacggctgtgtcaccatcatccagagcttgggcaggtgattcagatttggacagcctgagccaggaggcggagaggcaggcggagctcagatgcacactctgctccctcatggcacctccacgcaaacagcccttaacttaatggtcccttttcttgtataaataaaatcttgttgggtctgtgttccagctgcagtctgccctgcctggagatgcaaaaaaaaaaaaaaaaaaaa

SEQ ID NO: 265 - DNA, 2549 bp, Homo sapiens
agacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctcccacctgttccagaggtgcagacaagaggtggcgagagcccccgtcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtacctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcaatgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaaaaaaaaaaaaaaaaa

SEQ ID NO: 266 - DNA, 1056 bp, Homo sapiens
cggaggcagcatccgcttcccctcctccttctgcggcatctgcggcctcaagcccacagggaaccgcctcaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcggtgtaccgcaaaaccgtgattgcccagtggagggcgctggacctggatgtggtgctgacccccatgctggcccctgctctggacttgaatgccccaggcagggccacaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacagctaaaaaaaaaa

SEQ ID NO: 267 - DNA, 1984 bp, Homo sapiens
gggactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggtaggttccaggctgagcggcgggaggcagtccccggcagaggcgaccccagggagccaggccccatacggacgggcctctccgtggaggagaactcgcttcgcatttgtaccggttccgagttttccaggcacgatagtctctcttttaaacacatggtctacctcattgtagaaggagtgcctcgatgggtttgaacacacttctgtcatctcagggaacttggggtcctgcgaaggagcttgccttactgttgtgagccacattccgttacacatattgccagcactggtgaattgtagggcctgaaaagaaagctctactgtgtcactcgttttttttgcaaattgaaattgttcttgttgtataatgtgctttggggaaatgtttggtctctcaggtaggtgtgccagccgtttgcaggagggctgagagcgcctgtccactggtggccagacatcatcgggtccgcaggtgtctctgagtgtcagggtcacctcctgatagaagtgggagtggtgtcttactgccaggtcacactgaaggtgggagacaggaggacactactccgtgctaggaaccatggtccttgtcatcttcctgagagcaaacggggtcgggactccagcctaggacttggagactccctgcatccccagctaccctgcaggtgaaacttcactgagcccacttgacttcaggtgggagaggaggaggcacaccgttgtggtgtgcgttaccaaaaaagcagtaacctaactgtggaacagttcaggatctttagacttgatacttttcttgatttcccttaggggtcaaagttcacaaggaaaatagccctttagtgggaaactgaaacaggcttgtttttatttactatttactcatatttgtaatgcaattaaaatatatgttgttaacttttttttttttctcaagagctcggttgataaaaccaggggtatgtggactttttgagtctgtgccttttgggggtgtgtatgggaatgttatgttttaacgttttttacaaaatagaattgtctttttagtctattcgttagtggtttgcacaaggaagataatcgatagtcatgttttttagactctctgtattgcttggtaagctacgtagtaaaaaatgtttacttttccttaaatgttttgaatttcggggttatgaaatttgttgagtaatttttagacagtcacatcttgttgactggaggcatctagtggaaaaatgcagtatttcagcctgattgtgtttgaagtaaatgattaaaagaggaggaagttaccacattctggaagatttacttgagacagacgaaccttgaattacgggaaaaggccccgtgatttaggaaataacaaatttgggaaacatgtaatggggagagactggggaataccccagttgtgaaagtacttcctgtaaggcaacatctgacaccaggaacctttctcttcagtattttaaaaacaacttaatttcagtcctttacttgtggaatcagagccttacttatgtaatacaacccactggaaaaaagctttttattgtattgtactatattgtttataagtgattgagtacctgcagagctttcttttacttaaacatattttaaaaattattaaaaagattttcatgtttgaaaaaaaaaaaaaaaaaaaa

SEQ ID NO: 268 - DNA, 1047 bp, Homo sapiens
gcagcagcagcgcgggggagcctggaggagcagagagcagctcgtccccgcacgcccccgagagcgaaacccccgagcccggcgacgccgagggccccgatggacacctggcgaccaagcagcgcccggtcgccagatcgaaaatcaagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttaccgttagtgacgtcaggccctgtaacctgtgtcctgtctggcgcagttgctcacattcaccaaagtttgttttcatgatcctgatggccaagaacaccgtgtgggattttttttcccccaaggattttcacacacggaaggagaggtatttcttagagagatcatcattttatggtgccttgaaataaaaatacttctacttgaaaaaaaaaaaaaaaaaaaaa

SEQ ID NO: 269 - DNA, 827 bp, Homo sapiens
tcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttacggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagttgcataaagtgccctcacactgctgtgcagccattaccaccattcatctccagaatttgttctcagtcccaaactgaaactataccattcaaacaacagcgctccccatttc

SEQ ID NO: 270 - DNA, 2626 bp, Homo sapiens
gggtacggctgcgagaagacgacagaaggggatgtcacctgctttatttctggctttggcctgtggtctgtgatacccatcctgcttgatgttctgcagaatggcacttgactgctgggcatgcatgaagttaagggcaagaaacagtatgccatgtgttctgtaccatcatgtgtctcttcttgcttctgggcccttctactggtgaactttcatcaagatctgcgccatgccgtgtcactatcaagccattaagttttgtctgggttgctgtcagccccagttggcttcctggtcaacaaggacctcaagaactgcctgtggaccgaggccccctaccagtgcatgagacacacacctaccctccccagctttccaggaaccctactggctgccagactgatgggcgggctggtatgtgtggacatgtgttcactgtcattatgctgtggctccaggtgagggtgaggactgggcctatatagaatccagataccattgtcaacttcccttattcccgtctaagatgtgagcagagtgccatagtaggggttctgggaagaggtatttctgatttgtgggcctctgcttgcttgacttcaggtcacttatacttcttattttgcttgcctgccttcatccctcatttcctccctctcattcttctttcctccctccctttcctggtagcctcctttcctccccttctgccttccccttccttctttccttattcttttttattttgtttaaatagtaccacagagaaaacaactgaaaaaccacatttttctacatacagctggggaggtagctgagaacttggcactgcgcacacatactaggttgaaagagagttgaggaaaccagaaggccaagtggatctgctggcaaaccctgaacctgtctcctgcgcttgctctacagttctgaagttgaaaatcgttttcatgcctagcatctgcttgagttataaaccccaaggcagccatgtcatagactagtgtttactcttgttttgactttgttttaatgcttcctaagacccaagtgcctcctgctgtttcctcctttgtggtagcctctggccatctggacctcaatccccagctttcccactttcagcagtcctttgctctctttgcttctacctcaaatagccccaggagtgggctttagtctccaatatggagcatctcaagcttctcctgggggatggggattgggatgggcggaatctgttttggatctccgggttatttccagtgggtgtaaaagcagagctgggcctttccctctcttatccctgagggtgggtaagaaggactgtatctacacctgttcttccctaccttctcttttgttagggaggcctcattctaagttcctcaagagagtccttggcttaaagctgtagcaagggtgtgctaggtgggggatttggagcaaaaccgtcgagtaggcatgatactggtatggagtgggcctgcaaaatcagacagaaatggcttgagaagccgcagggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttttttgttattatttttttttttgctctgtgttatggacattttcagacatgcacagaagtggagaggatggtccttggaccccatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttcccttgcatctacaaaacaagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgtcaaaaaaaaaaaaaaaaaaa

SEQ ID NO: 271 - DNA, 1929 bp, Homo sapiens
gggggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagttataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattaccgagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcgtagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagggactgtatatattttttctaaatactttgtgaaatcatttttggtagcaatatctttgaatatgatgaataaaagtgactgtgagtgcaaatagaattagcagtaagaagctactctagctaatttgccatttcacttaaatggaaaatgtttttcaaataaatacttatgttgttcatgttccaagttattcaaaaaaaaaaaaaaaaaaaaac

SEQ ID NO: 272 - DNA, 1866 bp, Homo sapiens
attcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattaaaatatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaaaaaaaaaaaaaaaaaaaaaaaaaaaaaaaaaaaaaaaaaaaaaaaaaaaaaaaaa

SEQ ID NO: 273 - DNA, 1730 bp, Homo sapiens
gagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatatcttcattttaaaatattttgctgcgttttcttcaagggcggcttgtgacaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcatggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagaaaaaaaaaaaa

SEQ ID NO: 274 - DNA, 1034 bp, Homo sapiens
gacagactggtctaatatgctcactggtcatcacattcagcttattcttacgtgccagtgaggccctaaggtctcagtgcatagcatacctgccactctggatgttttcctgggcttcatatctgtatggcaaggagggagctgtccttcagcagacaaagtcaagcagctttaagtacaaggcagcttgaaacctctctgatgaaagtgaaaaatgtgggtagcttatactttcaaactaatgccagtgactagagagaggtttcattcatgatgtgtatttccaatttggtcttcaattcaagagatgcttcataaaacacttatagccttaaaccattcaagggctaattaaaaaaatagttatgaaatcttagccacaaaaaataaatcaggtaaacattttaacctgtcgttaagtgttgtaacttcaaaaaaccaaaatgcttattttaatgtgatttttctaaaactattgaaaaattaatatttctataatctattaaaaaaaatggagaatgttttctctcaaatttcctctgacccatgggaatgaaaatacttaaatactgtaaagcatatctattaataattcccccaattttttaaactaacaaaatggaatgttaactgaatggaattaaacatagcaattgtcaagccatcaaaattatatatcgaaccacttaggcatgttacggggtaaagtcctcacccctgcatttgagaaatattttattatttttattttaaggcaaaacagtgtttactgtgatgggcagaacagccttttgtatctaggagtccatttgagttctttccaatatttccatatcgttcataaatgtgtctgggggcttccttgtttggaaaatatggatatcgctttgttttcctttgaaagtaattatatcttaagaacatagtatcatgaatggagtagacagggaggctgcagaagccatttctctttgtagataaaaagcattatctatgattgttgtataataaattgatttttacattaaaaaaaa

SEQ ID NO: 275 - DNA, 4254 bp, Homo sapiens
agctcgcccaaagagatacaacctaatccccaacctacttttagttttttttgtttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccgtccttccaaaacggaatctatgtagacaatgggacattaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaataattaatggatgtgtgcacattttctgttcagggattaagaccagaatatcagtggatttgttttccccaccaagtggcctcttagactagtcattaacttatggttagctctaaagatttcaaatagtggcagacagtgtcttctgaatgtaagttttgagaaatacgagtctgtcagagcggccataagccataaagagtcaatctcttcattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcattcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacgtgcacattcctcccttacatgctcatttgtgccttaaatgtgccttataggtaaatccaggatgacaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaagctttgtaggacacttgtacttagtttgggaaaaaaaaataaattgaaattgttatgcttttgtatttccatttcttgcaaataaatattttttcttaaatagtaaaaaaaaaaaaa

SEQ ID NO: 276 - DNA, 2909 bp, Homo sapiens
aaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccaccgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgctctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttctttcaaaaataaaaaaaaaaaaaaa

SEQ ID NO: 277 - DNA, 2159 bp, Homo sapiens
ccacgctcggcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgtaaaaaaaaaaaaaaaaaaaaaaaaaaaaaaaaaaaaaaaaaaaaaaaaaaagaaaaaaaaaaaaaaaaagg

SEQ ID NO: 278 - DNA, 1130 bp, Homo sapiens
ggtcgccgcaccggccgcctccggcccgccgccgcccccagcgccgccgccgccaccgccggggcgcccaccgcgctgccagcctaccccgcggccgagccgcccgggccgctgtggctgcagggcgagccgctgcatttctgctgcctagacttcagcctggaggagctgcagggcgagccgggctggcggctgaaccgtaagcccattgagtccacgctggtggcctgcttcatgaccctggtcatcgtggtgtggagcgtggccgccctcatctggccggtgcccatcatcgccggcttcctgcccaacggcatggaacagcgccggaccaccgccagcaccaccgcagccacccccgccgcagtgcccgcagggaccaccgcagccgccgccgccgccgccgctgccgccgccgccgcggccgtcacttcgggggtggcgaccaagtgacccgctccgctcctccctgtgtccgtcctgtgtccgcgcgcgcgggtgcctttcccgccggggactcggccggtgtgcttcgtgctgtagttatcgttagttcctcttcccgagatggggccgccgagagaccccagcgcctttgaaaagcaaggtttgtgctgcgcttccagttccgaaaagcagatgtttaagcccttggactgagggtgggatcgcagctccgaagacggagaggagggaaatggggccctttcccctctattgcatccccctgcccgactccttccccgcacccacgtgccctagattcatggcagaaaatgaccaaatcctgtgtatttgttttatatatttaataactgttttaaatgaaagttttagtaaaaaaaatacaaaacaaaaagattaaattgctattgctgtagtaagagaagctctttgtatctgaacatagttgtatttgaaatttgtggttttttaatttatttaaaattggggggagggcatgggaaggatttaacaccgatatattgttaccgctgaaaatgaactttatgaaccttttccaagttgatctatccagtgacgtggcctggtgggcgtttcttcttgtacttatgtggttttttggcttttaatacagacattttcctccaaaaaaaaaaaaaaaaagg

SEQ ID NO: 279 - DNA, 2310 bp, Homo sapiens
gtcacataggagtgaggacttggtgggaggaagctggggcgtgatgtaatatgccttttgtttccagagagacagaggtggtagtttggctgggcagggagccttgctttaccccattgcttgtgttaactcacaccttcttgtttcctctcctgtccttttcccccagcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctgtgagtgatgcatctggatccacagtcatgtgtagcaggatggacctgggggttggcagggctgtcaccaggagagctgaggactgccgtgagggctggcaggactggccttgtgacaggcctgcactgtgtctcggcagggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagtaaggcagggcttgctatcttcttgttttctcaaagtcctcctttgagggctttcacaggggtcttgctaagggatgggccaccagaggccccagggaaatgttgggtattgggtcccaagaccctgggaccatgcgggcaagtagagattggtgcccaaggaatgccctgccaacgaattgctaattgttctcacctctgctcttcccaggcccacagggctgcagcggttctattccttgtcttacttatggtacagtgctcacaactccaccacagtgattgtggtgggcctgattgtcagtctactcactggtaagggtgtgggattgcggtgcagatgagcaccgagggttaacagagggccctaagggactctagggagaaaggctcctgccctctgagctcttgggtgtccgtagctgtcaggcttttctgctgggatgtaggaggtgggtgggggctggggtctctgggggccaagggaggacatggggcccgctgctgtggatggttccacccagagactcagaagcacatttccattcagggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaaaaaa

SEQ ID NO: 280 - DNA, 1465 bp, Homo sapiens
tgggccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagttttttttttttttaataataaaggggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttctttttttttttttttaagaagtatggctttttatgcatccttcatcgagggcattggagttgcatggactgataaaagttgatgcaaaacaagaaagaaacaaacaaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacagaaaaaaaaaaaaaaaaaaaa

SEQ ID NO: 281 - DNA, 1345 bp, Homo sapiens
gggaaaaactgtgcgtgtgtgtgtgtgtgtgcacgtgtgtgcgtgtgcacgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggcagaggttcaggtgagagtggctcacctctgagctggtgaagtgaggacttgcctgtgacatggcccagggatctgctgctggcttctggagacagggccttgggctgacttctcaggttgattgaggcctcctgactagcggtgttcccaggatagaggtgattggctgcaacaaagatgcttctattagtctattagcagtgccttcgggaccctgggattttgctctctctagaaaggtgttttttatttttttattttttatctcccccttttttcctggctttgctccaaggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaaaaaaaaaaaaaaaaaaa

SEQ ID NO: 282 - DNA, 1543 bp, Homo sapiens
agcgtccgtatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtaaaaaaaaaaaaaaaaa

SEQ ID NO: 283 - DNA, 2535 bp, Homo sapiens
accaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctaaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaaaaaaaaaaaaaaa

SEQ ID NO: 284 - DNA, 4461 bp, Homo sapiens
gggcttcatgtataatatcttaatatgtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacgacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaacgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagctttttttttttttttccttaatagagtctcattcttgtcacccagactggagtgcgatggcacgatcttggctcactgcaaccctccctcccgggttccagcgattctcctgcctcagcctcccgggtggctgggattgcaggcgcacgccaccatgcccagctaatttttgtatttttagtagacgtggggtttcaccatgttggccagactggtctcaagctcctgacctcgggcgatccgcccgtctaggccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgatgggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgactccactgctttaagcctctgtcttcatccttaaagtggcgatgatagtacgtacctcactctgatctctgaatgagaacacatgtaagacacttagcacagttcctggtgctcaaagagttccaacacctgaaagcaccatggccctgtttgcttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctagttctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaacgacaaaaagcaagctagttgatttgtcaattttgagtttaaatgttttgactgcttatcagcaaaaaaaatcaaagaatagcatactaatattaatggaaatgcagagtatatttaattggcatgattttttcacggatgtgtgcttcatttgatctattgtatgtagctcgtgatcacattttctgttggttaacattgttcctagcttatatgatggaattaaatatattctgtgcaaaaaaaaaaaaaaaaaaaa

SEQ ID NO: 285 - DNA, 932 bp, Homo sapiens
ccacgctccgagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaaaaaaaaaaaaaaaaagg

SEQ ID NO: 286 - DNA, 2893 bp, Homo sapiens
gtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaattgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaatatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagatcctgaaatggaaaatgaagaacagccatcctctgaaaatgattctcagaatcagagtggtgaacagagttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtgaagccagtgtactttctcagtgagttctctgcataaagactaatcagtgggaccaggtaaaaaggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgtttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaatgaaaaattgtacactttctgattttaacttcactaatgtaattactctctcaagaagcttttaaaatttaaattaccatcacacaacctttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattccaaaaaaaaaaaaaaaaaaaaaaa

SEQ ID NO: 287 - DNA, 3164 bp, Homo sapiens
gcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacgtggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaaaaaaaaaaaaaaaaa

SEQ ID NO: 288 - DNA, 3682 bp, Homo sapiens
cggggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgctagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgccccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcccgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgtaaagttaaaaaaaaaa

SEQ ID NO: 289 - DNA, 2164 bp, Homo sapiens
cctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcatcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaacttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacgtgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaaaaaaaaaa

SEQ ID NO: 290 - DNA, 803 bp, Homo sapiens
ccgacggctggctctgtgggcggtggcatgggcagacggaacccgcgccagtaccagatcccctctgaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccaggttcccaagttcacagtggactgtgtttaacagaccttagaggttggttgagcctgagtggagccccttccatgccagcgctgacagtccccaagtcctcccagggaggtacaccagacctttctcctgaaggtggaaccaggtggcaccctgcttatctcctccttgtcaccaacataaccctttatcgcctgcagaattccagcttcccgtgaccgaacctgacatcaacaacaggctggagtcgttgtgcctcagtatgaccgaacacgccctgggagacggggttgaccggacctccaccatctagaagctgaagacgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctgggaaaaaaaaaa

SEQ ID NO: 291 - DNA, 1444 bp, Homo sapiens
gtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccctgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaacgtttagctagaaaattccacagcctgtgaagaaatatttcaaaatggccataaaggaggtaaaaatgaaaaaccataacctaacttttatagaggctttatctttaatttaacgatgtgcggaggactttcttgcttgaatctgttccgggctgtctgctctgtccatcaaatgggcaggtctggaatgaggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggtttttttttcttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaaaaaaaa

SEQ ID NO: 292 - DNA, 1984 bp, Homo sapiens
tatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttggaaaactacattaactggaaagttgaaaaactacattactttggagaataaaaccgaaagttcgtgtataccttcttaaaaaaaaaatcaaaccaaaaatgtgaaaacaatagaactgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattattcatttttgataggaaaatgaaatttttgcaaacagacattttcttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatattcctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaaaaaaaaaaaaaaaaaaaaaagaaaaaaaaaaaaaaaaaa

SEQ ID NO: 293 - DNA, 1848 bp, Homo sapiens
gctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctgccatctttgctctaagcactatgactagttctgttcagatttataatttatctcagaacattcaagaagatgatcttcaacagctgcagctcttcacagaatacggtcgtctggcaatggatgaaattttccgaaagcctttccagacactgatgtttttggttagagataggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagcctacaacttagcagctgcagcctctgccaaggacatttattataacaacatggaagaggtttgtgggggagagaaaccttatttgtctccagacattctagaggagaagcactgcgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctataaaagaaaaaaaaaaaaaaaaaaaa

SEQ ID NO: 294 - DNA, 2544 bp, Homo sapiens
ggtggcggtgggcggaactcctagcggacacctcgtggagtccggccggaagagcaaccgagatgaaggtgaagatgctgagccggaatccggacaattatgtccgcgaaaccaagttggacttacagagaggttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagataataacttatatacttttgatatgcgtgcactggacactcctgtaatggtccatatggatcatgtatctgcagtgcttgatgtggattactctcccactgggaaggagtttgtgtctgctagtttcggtaaatctattcgaatctttcctgtagacaaaagtcgaagcagggaggtatatcatacaaagagaatgcaacatgttatctgtgtaaaatggacttctgacagcaagtatattatgtgctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagtattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacaaaaaaaaaaaaaaaaaaaa

SEQ ID NO: 295 - DNA, 1347 bp, Homo sapiens
gacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgaggagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctggaaatgtctgaactaagtgccatactcgtctgggtaagatttgggaaacataacctctgtacataaaaaaaaaaaatcagttaaacatcacatagtagacagccattaaattataaaaaaattaatttatgaagaaagaccttttgtacagattgaaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaattttaaaaaaaaaaaaaaaaaaaa

SEQ ID NO: 296 - DNA, 2958 bp, Homo sapiens
acgcgtccgcaccgtggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacctgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtcaaaaaaaaattttttaaaaattaaaaaaaaaaaaaaaaa

SEQ ID NO: 297 - DNA, 5736 bp, Homo sapiens
gttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccatagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccatcgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggtttgtgctcagagccgctgcaccccagcgaggcctgctccatggagtgcaggacgagctactgctttggagcgagggtttcctgcttttgagttgacctgacttccttcttgaaatgactgttaaaactaaaataaattacattgcatttattttatattcttggttgaaataaaatttaattgactttgaaaaaaaaaaaaaaaaaaaaaaaaaaaaaaaaaaagg

SEQ ID NO: 298 - DNA, 8434 bp, Homo sapiens
aggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatcggggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaaaaaaaaaaaaaaaaa

SEQ ID NO: 299 - DNA, 2537 bp, Homo sapiens
ggttgagaaaggggcatccacagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttatgtttttcttcttacacatgaaaataaatgcataagtgttagaaaaaaaaaa

SEQ ID NO: 300 - DNA, 2254 bp, Homo sapiens
ccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtggggggggtctttcagtgaatatttttattaaactctactgtggacaagaaaaaaaaaaaaaaaaaaaaaaaaaaaaaaaaaaaaaaaaaaaaaa

SEQ ID NO: 301 - DNA, 2939 bp, Homo sapiens
atatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgctgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggccttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattttttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgtttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccactgtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttcaaaaaaaaaaaaaaaaaaaaaaaaaaaaaaaaaaaaaagggcggccgctctagaggatccaagcttacgtaaaaaaaaaaaaaaaag

SEQ ID NO: 302 - DNA, 2986 bp, Homo sapiens
atttttaaaacctcctctttaaagatttcctcttgaagagacagctcactttctacatagtcccgtatggaagtggactgctgaagaaattagtgtttccattcccctccaccgtctcccccattttttccgaacatttctttgtctttgtccattttcatcgctgagctgaagagcatgctttatcagaaacccttttgtccctttccttttccatgcttagagggaagtttctgacttgggagaacgccttagagttcttggggtctgaactcctctgatgccttccaaagtcacgtagctgtaagacccagcgggtgccagccgggagggtgactccagctcagcagcatgtatggaagtgcattgtgaccatgaaggagtctgccagtggccaagccacctagtgagctccctaccaaggaacctgggtgtcacctgcaggtggccaagagccagtttttatgccaggcaggggactggttggactctattgaggcttcttcctgtctgtggggagcactcctgtccccctcgtggtagggatacctgtcaccccacaaagaggcagggtgacaggtgttggccccattttaggcagacttgggtgtcatgacttctagttcacttgttttaaacctacctgtgatggcagctgcaccatgctgccctcttgacacactgctggagcccagagcacaggccagagtctcagcctgagccccttccccaggcagtacctgacaaggatacctgggattggggccagctttccagtcagatgccacgtttcctttgcccactgccacggggcactagggcctgccgcaggctctcccatgagggagaacgacctctgcaggcccctctgccttcctgcttcctaattgaccctttctctggcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaacactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccactgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagataaaaaaaaaaaaaaaaaaaaaaaaaaaag

SEQ ID NO: 303 - DNA, 1410 bp, Homo sapiens
gagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagtcggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggaaaaaaaaaaaaaaaaaaaaaaaaaaaaaaaaaa

SEQ ID NO: 304 - DNA, 2492 bp, Homo sapiens
cagagcgcagccaacaaagcagcagatagcagtgtacagaaagcaaaaaaggaactgtatgtgaggcacttgtttctgttaatatccatattcctgttaacacacaccctttctcatgtaaaaagaaaaataaataaatggtctgaactttgaaaactttgtgctgctaaaacatagattttggagacaaataaatagatgctttgctgtttcactttcatagctaaacatcaacagaaaccatctccccttgcccccaaagtgtgaaatccttcttcccttcgttttcttcctttatgtttcaaaagggaactttgaagactgtgaatacaggttccattggtcacctttcgggcttctttccccagtgctgaagccactcatcgactttgcaaaagactggagcattccaagatctgaaaatggattttttttctttttttcttttttagccgggactattttatttttatgaatttgtttttagtttaatgaaatagtagatcctgaaatgttgtacatatttctaactaggctgatgcacagtgcaaattccttttttaattgttttttttaagtagaaatactaaagaaagaataccatctaactattcataccagtatccagttgtagcataaggtgtcaaaagcaagtacgcaaaacatttactgttttaacaagctatttccttttaacaagaaatcttgtatttcttcctgtgtttgagatgaacatttttaaattttaaagttgtacagttttttgttttccattattttatcttgtttgtaactctatgaaatatatatatatatattttttgccatttaactgttgtatgttactctgtgtctgtaccatatagaaaaaaaattgtttttgtttttggttctctatgtgatatcagttaacaatgtaacactagctttacctgtcaaattctgctaggtcttctctgaaaacgttgtttttaaaaatgatattgcttggtaatagtgcaatttctatccttttccctcccccctcaacttttaagttcttttctttataattttgctgccccctccctgatggtttgggtttttgtttttgtttttgttttttttttcatggagctactatgccatcctccctctgtgaggcagagtgactgtcagtgttttgttatgccatgccttgagctgtgggtgtttggcgacaataaggtggttgaatagattggctgagcacacttccacccacctagtgttctcagaggggttatgtgattgtttcaacctggagtgggttgcacccttaatgctttcctctgcaactaaaccgcccacatatatgttcattgaaaaaagtaagaataattctcagcactaacccagaagtagcaaagcagtcagtgatggtgaacattagaggtcaaacatgagatagatgtttgtgggctgacagccatcgtggctatgaccagtactatttacaaagcatgaattcactacaatgctcaactgtttgtttagctttatctcacttggggaatttattcctgtctgctgcattgtaggtagctgggtaggatatatttccacttgctttttaaattagttcttcacctccattgacactcgttttttggttttctccctatagtgtgggttggtgctagacaccagtctgacccacggaatgggagttatttcatccatctttcctccatccttccaaaaaccacatatctacacaaggaaaaatttaatacatctaggaattttttttttaattacaagctatttaaagagatgaatgtggccaaagttttacacaattgaaaataaagtaaaacagacggcatgtgtttaaacctgagtttatcaggcatggcaggaagttgcaggagagagaggcagtgacccaagccagtgcacttgatgttcatggacatatattttttttaaataataaattaaaacattttaaatagaagcataaattgagttgtttgttggcgctgagatactgcccactgtgaaacaaagctttgactagttttttgtttgtttactttcttcaggggggaggggggcaagtttgggtaggaaagaaagcataaatgaacgtgaccctgaggtgaagaggtatatgaacagcctttgcaatgtataaaaagaaaaaaaaacaaaaaacaacaaaaaaaatagagcaagtgaaaccaaaaatgatgttcttggtgtttttctataatgtagtcttgttagcttttttgttactgtaacaatgctgatctcgaactgttccaaaatacatggagactaacaaacagaaccacatggaactttcaaactgaaaaaaaaatttgtcacaaaaactttgttgtcatagttaagttgattgtagatggtaattgaatatactcctttgaaaatatttcatcaagtatgtttcctgctcattgtgatacattaaaaaaaaatatgagcaaaaaaaaaaaaaaaacaaa

SEQ ID NO: 305 - DNA, 7028 bp, Homo sapiens
caaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaaggtgagtggcccagtggggacaggtggtgctgacgctctggggcaggtagggttgctggagatgctggtgagatggtgggatgcaggtcgtgcagtgaattcctggaggacccctgagtctgggtgatcctgtgtgtcaagggataagcccggggcaaggagggcctggagtacctcagagacccagtgtcatcaaaggaataaacacacccccacctcccaggatgtcagaaccagagagggtttccagagcctcagcggatggcaaacacaggctgcttgtttgtagctgggccagagggagggcctccaggtggctccaggcttctgggagaacaaggccccacaccacacttcttcccccagcacccagtagagtcctctgcagagtcctttctgcatgccaggcgctgagctggtggctttacctgggtcatacccccccagtgagatgggcacactaacttttatggccgagggcaccagcccacagagacggagtgtcttgcccagggtcccagagaagcaaaggggctcagcctctgaaccctggcctggatccacagctgcccgtctctgccagcctctgcagctgtgttttcttttggctggaaacgggatagatgtgacgttggggagggggtgctgctgcttctggaagacgtggcgtcacagagccttgtgcccgtgggccatcttctccgcccgtccctcttctgagtcctggtgttccccgcagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatatgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcaggtgctcccacgacgcacgccctcctgaggccccggggactggcgagtcctgggctgtcccccaccccaccccgctggtcctccaccccactgctgcctctcctgaggcttcccaggtctcggccccagatctctggctcgtggttctggcttggggcctgggaagctgtctgtgcctagagcctctgttggttgggatggaagctgtgagtccagggaacctctgaggagcctggtggccctgctccacccacgggccgtgctgtcaccagccacaaggtggcgccaggagtctctcccagctctagccattcctgctgggccggggattcccacagggctgtgctccagaactggctcccagagccgaggatgatttgaatgggcggctgcacatctccaggtctgtggggtgggaggtcagttgggtgggaacagttcaactgtactcctacttccagcttcttccttgaaagctgcaggcagggctcgcccgtctgtcggtcagacgtggagatggcatttgtggggaaggcctccctccagcccctcctctggagactgtggactcgtggtggggtggggtgtcgaggagaccaaatcccacgagcccggggagcaagctctgcgtcctttctttttcgtgacagctcaaacctggcaaagaagataagcttttcaggaaaaaggtaccatcttcccctccctcctgtgccccaggcctgagcggttagagctgcaccgcagctccctgggccacagtcccgtggcaggggggcgggaggccttgggcgggcgcagccctgagccccagaggctgacgcgtctccgctctcgccctcagcggcggtcctggaagaacgccgaggaccgcatggcgctggccaacaagcccctccggcgcttcaagcaggaacccgaggacgaactgcccgaggcgccccccaagaccagggagagcgatcactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccaaatgcgggatctcctgtccccgcccacagacaacaggccaggtgagttgccaggctgggggtttctgtgggggtggggtgagcgagctagactgttggatctgcttttaccctcagaccccagctgttccccaaaggacatagggatgagtctctgctgccatgttctcagtttgcttcaggcacagaggggatctgggaggaggcaggggctcctgtgcacacgtgagactcgctcctggggctccgcgtgcgtctctctgctttcctgttgactcgctcatggggctctgcgtgtgtctcactgctttcttattgactcgctcatggggctctgcgtgcatctcacttcttttctgttgacttgcccctcgttggtttcaagcctccactgccatcgggatcagtgtggttgtgcaaaggcttccaggatggcacctccccctggactgggctggactgcctaggtccgtgcttctcgccaagccatggggatcggagatgctgcgcagcctctgcactggttggctgatgactactgggtggaatgtgggcatagtgtttctaggtcttttagtttttcaagagaatctgaaaatctaagttttgatgtggagtctgatttttcactgttggaattatgattttgggaggaagcagtttataactaaatgaaatctgagtgttctgtctggctggtgggccttttagagtgtcatgtcagcatgaccaggcctcctcggtcagattgacgggttgccccctccttcctgccccaccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaaccaaaaaaaaaa

SEQ ID NO: 306 - DNA, 2224 bp, Homo sapiens
atccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtgagccaccatgcccggcccataagtaccgtttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttaaaaaaaaaaaaaaaaaaaaaaag

SEQ ID NO: 307 - DNA, 3447 bp, Homo sapiens
gggcacagggtgctccccagacctccctcctccaagtagagctgaaatgggaaggaacccctgggacagcccctgccctgctagatctttgcctcagattgctgctgtggccaggcccaggatctccagccctatggctctgagtcctgacatgctgggggcccaggggctctggacacactccatccagggatcccttcctgccatctgggcagcaaccatggggacaaagggaggaagcagagtcctgtttccttgccacttgtccaaggcacttccccatcctgacagcggcccccacccagcccaggattctgggttgtggtctcgagctcacttcccgttatctttggggctggggctgacatcaggaggacatctgactggtggatggagccagcctgggaacatcgtagctggggcagtgcctagggctctcccttcccagagagacatggagaatggggttgagggagggcccttccctagccgctgtggcaactccagtgagctgttctgggcaaagtgtggcccaagtcggcagccccagccctgcagtgctggggacgctgacaggacacgggaagaggccatgctctccctcgggacctgctgttccatgtgtcccaagccctcctgctttccagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcatgggcgtcttgcgggcggtagcgccgacactgtgcgctctcctgcagacagcctctccacgtcaagcttccagtctgtcaagtccatctctaattcaggtgagcaggctggcgtccatgtgctcacaggggtgagtgccccacggggaccccagcctgggtggcctctaggggtgctgaccaggtaccctctgctgggccaagctccaggatttggggatgaaggtgcagctgaaaagagccctgcaagctgaagccaccgggaggggattaagggggggtgggcaggaccagggaccagtcacagggcagtaaggcctcacagcaggcaccccagggtggggcagcaagcaggcaggaggggcctccccgggtggccgcctagggaggacgtaccctggctgcccagcagcagccctgcttggccgtgtccccgccacaagcaggcaggacacaggagggatggcactgcccacggagccctgggctcatggcaccttctgcagagtgaactgggagcagagagcctcttttccccactctgtgaggccgggcattttcctcagcccagccctaaccctcaccattcctgtgatgggcccaggtgctggacgggccttgtccttgccgaggaaacccatgcaggctgggtcccaagcctctcatgcagtttcattttacccaagatggggccagcttccactatgttgattgttctagagtgttcacaggcaccacccatgggcttcaccctcagaaccacattgattccccccagaaccctccaaggcaggcttccctttacagaggaggaaactgaggcagggacaggggcttcttgggtacacacagctgttcctggaaaacttgggcggtgactgttggtgcctgcagtgaccggccttgtagggtctgacttgcagccaactctcaaggcaaggccaggccccagcccggctccttcaacaagcaagattcaaaagctgacgtcccccagaaggcggacctggaagaggagcccctacttcacaacagcaagctggacaaggttcctggggtacaagggcaggccaggtaaggcttgggtgttcctggggtgcaagggcaggccaggtaagtcttgcctgcaccctaagggccccatgactacatttactaggctcacgccctgcagtcagccaactgctctgcccctagctccaggggcctgtctccagggctcatgatagcagatgacggccacgctctacccatcggtgggcgctgtcttcctcccttcccctgggggtcctgcagagtacctgtgctgacctgagcccacgaggggggccagtagcggcccctaaaccacttcctcagagaaaagtaaagtaatattctgaccaagagaaggcttgctgcccctggccacagcctgcctttggagggcactaggccagcaggtcagagtaggaacaggttctggtgatccctgagtttgcgggactgccctgagatgctacagagcgcacactttcagcagcgcaaccagcaggacaggctcctgcatctgcacatcccgagaccaggcctggagcaagatgccccactgggtgtggggtcacgaccaagagcagcctggcagctagctggtcacccactgaagcccatctgacccttagggcaccttcagaggggagaaagggacaggccccagtcccagagacccccacctggtgcccagagcaccctgctcagtgggagaggggaaccaggccctcttccccacattggcctgggcgctgcctggggaggtatgctgggtgggtggttagacgcacctgggcaggtcacctctggctgctgcaatgactgtttcagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgacacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaaaaaaaaaaaaaaaaaaaaaaaaaaaaaaaaaaaaaaaaaaaaaaaaaaaaaaaaaaaaaaag

SEQ ID NO: 308 - DNA, 4018 bp, Homo sapiens
ggcagcaggccgaagctcttcttcttccgctcgctcttggccttggttggccgcagcttgcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcgggggggaggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacccgagagaaacgcaggtgttccagaggcttccttgcagacaaagcacccctgcacctcccatggctcaggatgagggaggcccccaggcccttcgggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaaaaaaaaaaaaaaaaaaaaaaaaaaaaaaaaaaaaag

SEQ ID NO: 309 - DNA, 8281 bp, Homo sapiens
gaccaatgaagactcaccaattatagaatattacccacctgattttaaaactgacctaaatgggaaacaacaggaatgggaagctgtggtgttaatcccttttattgatgagcgattattggaagccatggagacatgtaaccactccctcaaaaaggaagagaggaaaagaaaccaacatagtgagtgcctaatgtgctggtatgatagagacacagagtttatctatccttctccatggccagaaaagttccctgccatagaacgatgttgtacaaggtataaaataatatccttagatgcttggcgtgtagacataaacaaaaacaaaataaccagaattgaccagaaagcattatatttctgtggatttcctactctgaaacacatcagacacaaattttttttgaagaaaagtggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcaccttgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgaagggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactgctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcattaaaataatatcacagtatcagtggactaaacattaaaatgtaccactctaatcattggcctcatgattgaagcatcctgaactatgaattagacatcagttagcaataataagcattttttacactatcattgaggaataattacatggagcatgaaatttgggcctccagtataacttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgtataattattgcctcataaactctctctttgtttttaaaggaaacatctattatggtaatacaaagaaaagttaaattgtgacagtaatgttatattaacctcttcctactttaaagtgtgaaatgtttcacctcagctgtacaaactccagcattgagaatttgcctcactcattactcctgtgtgacagttatataaatagcatgcagctcacatctgttttagagcatagaagaagcggcacctgccatcttctgaaaactccaaagggaaatttcagtagacatagtgcactaaacccataaggatacttgaccaatatttgagcacagcaagctgacagttctatacagataggcagtgaaagagttttattttccagccaggcgcagtggctcaaatcccagcacttcgggaggctaaggcaggcggatcacttgaggtccggagttccagacaagcctggccaacatgatgaagccctgtctctactaaaaatacaaaaaaaaaaaagaaaaaagttttattatccttactttttttttaacattattattctaaaggtcaaaactgagaagagattaagataggagagagctccataatggctggatagtggtcaggcattctctattcttttccccctgtagacccattctaaatgtgggcctgaggtcaatgggagatgtgccctccctatggaggatgtaagaagcagaggccatttctgccccatgttgaggaaacaatctgttgatagacctggaatttagagtacatctgaaaagcagttggacttcaagaaatttaaaattctctctttgagatggggtggactaagaccacccccaaagtttaaaaatatgctcattcaacttgaatcttctgaggactttttgtgaaaatggtggactgtttagggcataggacagattccccaaattgctttatgcttccacataactagagcacttcaatctatttaagcctttgtctcctaactgaaacattatttctaaatatttctattcaataagttttttcttttttgagcaacttaagtgaattttgaagattgctccttccagtctcgttccttttcacattttcctgcattacctaataattacctcagcgttagaatttgaatgtattaattgatttaaacatcatgtagactaaagtcttaaacatctaagactcagttgtagttgcagaaaaaaattaaagtcacctctactgaaccttggtttcaatttaagatttttcttgcttttcaaaggggtaactaataaagattgaagggtttttttcccgattggtggaggaatgaagaactattgatgcaagtttttttattgtttctttctatgatcaggtacctgctttcattttagactgctacttccaaactaagctagattcttggttttaatgagaggaggcagagagagggaggcagatggaagaagaaaaacagttaaataagacatacccagtcactgcatttttggactataccgtatctttctagcacaaggaaatagataaactgtaaggtcttttttactcactttttatttatgtgttctatttgtgttagtcataactgtttatagtggttgtctaatttttacttttattatatgagatagagctgtgcagatcttcactcaagttctgtcacgcttcttcccattatttagagcacagttttttaaagcaactgtacaatttctcagccttatgagcttgctgtatttcttggtatcatgttgcttccaaattttgtttttactgtagaagacaattaatttattgtagagaagtggctgtgaaagtcgttctctgtctttaaaaatcaattgcagaagttcatttgtcatttttctagagataaattatagtactcaaactggcagtgctcagtatatacattttgtaagctttgtcagtgaaaccatcagttttgcaggagcttcctttcctagtcaagataaagcttaaaattccagaaattaatgtcgttcggactgactttattcatatttccatcaaacttctccaatacagtaagagatagtgttgaaccagcatcaagtctccagaaacatggcagagcagacaggccgttaagtttcacagacatcatagatccttttcttaaagaagaaaaacatgtataaaatagttttagtagtccaaaatgtcaactatctgtagctgcttttgtgtgtgtgtcagtgaacaaataataatgccttgctcaatcaatgcattcagccatctcaagtgcaatttgtgaaggagactatggtttccaaaagatacatttttttacaaagttaaacctgtaaaaagtctttttttttttccctccagccgtacaccaactgcacttggttgtttcagcagttggtatactattaaattgtccaggccaaataggtttctgtagctgttttagtaatttgaagccaaattctcatgctgtttctcattaaaaagaatgagaatttggtccatagttagctttaagttctctcttcctttctttcccttacagttaagggtttggtgggggatggggaggttgttttcgttttttggatttttttgtcttttggctttaagtatcatattttcttttgcctgtatccaactgcttctttgagtattttcatctagtttaatgtgagtaatagatgctgtgctgtcattgaagtgttcaacattttgttcatttaaacaaaagtgtaattcatacatatatagatacatatcttaattgatttctcaactattttataagtaactggaatttttcattagatcttatacagagaagtattttattaaaaattcaaaagggaagacttttatgtgctcattttgtaatttttgattttaaatatctttacattgtctgccaattaaagtgttttaaacttgcattggaatggactccgaatgtatttttgtggtgttacgttatccgtagatttctagcatgaagttagcctcacgatgctgtgcaaaggattttaaaatatgagagtcactgaaagagtttaaacatctgttcatgttaaatgctctatggattttaattaaagacttgagaatgattttaaaaaaaaaaaaaaaaaaaaaaaaaaaaaaaaaaaaaaaaaaaaaaaaaaaaag

SEQ ID NO: 310 - DNA, 2049 bp, Homo sapiens
gtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggccaaccaatcaatggctcagacagataagccaacatgcatcccgccggagctgccgaagatgctgaaggagtttgccaaagccgccattagggtgcagccgcaggacctcatccagtgggcagccgagtacgtgctcctttctcgccttcaccccttggaggacggccggagacagagggtcctgtaaaaccgcggaggttgtcatggctgcagctaggaagtccggactaactggcatcgtctttgttttagctcttgcattgctttgatgctttaaaatccacacataaatgctacatctagctgggcaaggatgggatgcctcccctaagggagccagattgagcagtaggacgccaggtcaataggccgtgtcctggggcaagcagcaagttagatgaccgcgtcacaccagcgtatgcacacccacctcctccctgcacgccttttcccactcccggtggaaagaagggctgggaatctccgaagcttaatctgcctttcttcgttctcctgtctcaccactagatggcagcagtgcagccgggggagggaagcgacagccctgggtggatggggtgggaccagtcctgctagttcactcctttaaggagacacttcctcccctgctgttaaaactcatacttggacccaaccaaagaccctttatatcttgtcttggaggaaattattgttattttctttagtgtttctctgaactgattttgttctgccaacataaagatgtccgcacagtacacactgcattctggggaaaggccaagcagagtgatggggtcctcaggcatggctgaaaacagtgtgcctcaaacacgggtgccttctttcaggagagacctccagaggctgctcagtagatggagcttacacaacaatcgctgcgggcctggattgaagtagctttgcacagaaagcctctcagctatgaaattgctccttggacaaacttgcctgcttgaaactggggaaccaggacttgagacaggagttggaagataactagacctcacggaccattttcaggctatttttactgtttgatgattccctgcttaggagggtttcagtgggaaagtgagagtgagagaggccgttgagagaaagccagtgagttggggaagggaagatgtcctcaggctgaggttgtgagtgggtgtcctgggcagatggtggggagagtgtggacacctttgagaagacacaaaatggcatctaagaggggcctttcggagtctctgggccagtgctgtgctcctggactggattaggatgtagcttttacaattggaaggaaaataagccagtggtgctcataaaaagaaacataaatgggggttgctttgcctagtaatgagccctgtttagttctccattttaaattttatatattgcctctaagattgaactttagcttcagaagactaatttattttggcatagtcagatagacagactttatcttatacgttagtttcaaacccatttgattgttcttgtgctgccgttttatagtaagcaaactgacattgcttagtattgtccctgacatttatggaagaggcattccactattgtagactgcttgctctcgtattgtatcacgtgctataatttttttagacatccatgaaaacttagtttgtagtttaaccacaatgaaaaaggagggcatgacctaagagccccctccattctatccagacatgaaaagcactgctcagatggttgtatgtgacttacttaaaacctgtagcattttagagaataaaactctgcaaagtgtttccaagacaaaaaaaaaaaaaaaaaaaaaaaaaaaaaaaaaaaaaaaaaaaaaaaaaaaaaaaaaaaaag

SEQ ID NO: 311 - DNA, 1337 bp, Homo sapiens
ggggaagaggaggagtgcccgatctgcacagagccctacgggcccagagagcgccgcctggccctgctgaactgtagccacggcctgtgtgtgggctgcctgcacaggctgctgggctcggcctccagtgccgacctgggccgggtgcgctgcccgctgtgccgccagaagacgcccgtgctggagtgggagatctgccggctacaggaggagctgctacaggccgacgggccctcacgccagccccgccgagaggcccctgcatcctatcaccgcaaccctgggccctggggctccctggagcaccgctaccagctgcgcttcctggcagggcccgtgggcggccggggctgcctgcccttcctgccctgtccaccctgcctgggtgcccggctctggaccctgcgggagcggggaccctgtgcccgccgcctggcgctgctgagcctgctggcccttgagcttctggggctgctgctggtcttcacgccgctcctgctgctgggactgctcttcgtgctcctggaccgctctggccgctgagcagagcccaggacagccccgccgccaacaggccagggggcccagactggcccacgtccccatgcctgggtgctgtgaggcctgatgaccaggctggaaaaacccaaggttgggtccagggcagtggccttcaatcaagacctcccattgctgaacccacaaccagggctacccagaggcctgaccctgccagagtccatggctgcactgctgcccagacactagctgaacccaaggacaccagcgcccaaggacagctcctggaggaggccagcccagcaggaaagtctgtgagcaggaccccattcaccctgcggcagacgggcaccgtactggccacgggctgacgccggccacacttcccctccgagggccagctgagcacagcaggcatgaaagcaaacagagatacagcagtgagtcagttccttggagagggcagggactccgcccaccctgtgttcagataagggccagtgtgtgtccctgaaggtcaggccagccgggggaggggtccatgctgcgaaaattcagcctgcaaaggctcctctccccacttgatcaggcccagaccaggtgggggttggcgctggcctgtgttgcaggggacaagggcccacccaggccttggaacataagctctgcccctgcacaccctcatgtcaccacacctgggatggagacatcaggtggcccagcgagagatggaggactgatcctggaacgtgaagcagctttcaataaaccagctcctggggaaaaaaaaaaaaaaaaaaaaaaaaaaaaaaaaaagg

SEQ ID NO: 312 - DNA, 2518 bp, Homo sapiens
gggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgagtgagcgccccctggggcacccaaaccaggatggggctcccacccctctccccagctccgcatccccggcgctaggacgcgttccccacgccgcgtccgggccaggagctcccttttccgtggacctttgctatcctctggtcttcgggccgcaccccctcccaacccattttccagtggggggcagcctgtgtcaccttcttcacgtccttcccgctcattgactgccctcgcccacgccgcctcaggaccctgttctgccccagagcccggagggcggagagcccggcgaaggatgagttggccagttccccgtcgcggcccggcagcttaaaggctaagggaaaaggggtttcacgaaggagcggggttctttttaataggggacatagcggttgggaagactcgctcacccgcttcccggctccagcgccccagttccctgtccctcttaccgtagttcccctccccctccacacccagaaatagcccgcgacaccaggaggccgccagcttccccaggagcggggagggggacgcccggggtagaggagggtcccatttagatgcccttcagcctgccaactcgtgctggcctggcaaagaagcggaccccctgcccggagcggccggctggcccccgggctgtgtgtattttaaatgcatctgccgggaacgcagagcaccgagggagatgggggcgctcagttcgctgaggaaggtggctggtggcccatggacccaccaccacctcccttagcctcctgtgtgggaggagtttatgggtatgtggctcctgcccagtccaggtgggctttcacttctactctatttcagttcctctttcccgatctgggctggagagcttcctcattgttaaggcagcagaaactttcgctggatggttttaggataaggggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctgaaggaagtgagccacgagagcctggtagtgggggccattgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaaaaaaaaaaaaaaaaaaaaaaaaaaaaaaaaaaaaaaaaaaaaaa

SEQ ID NO: 313 - DNA, 1644 bp, Homo sapiens
caggctttcagcagccacccctacactagtgggcccagtgcctgcaccagctccttgagcttctccctagtggggagcttcactgtgcagcttctggggtggcctgggcggaggctatggtggggccagcagtatgcgaggcatcaccaccatcacggtaaaccagagcctgctgagcccccttaacctggaggtggactccaacatccaggctgtatacacccaggagaaggagcagatcaagaccctcaacaacaagtttgcctccttcacagaccaggtatggttcctggagcagcagaacaaggtgctggagaccaagtggagccttctgcagcagcacaagatggctgggagcaacatggacaacatgttcgggagctatatcaacaaccttaggcggctgctggagccaggagaagctgaggctggaagcggagcttggcaacatgcaggggctggtggaggacttcaggaacaagtatgaggatgagatcaataagcctacagagatggagaattaatttgtcctcatcaagaaggatgtggatgaaacttacatgaacaacgtagagctggagtctcacctggaagggccgactgtatgaagtggagatccgggagctgcagtcccagatctccaacatgtctgtggtgctgtccatggacagcagccactcctggacatggacagcatcatcactgaggtaaagaggcagtacaaggaggttgccaactgcagccgggctgaggctgagagcacgtaccagatcaagtatgtggagctgcagacgctggctaggaagcacagggatgacctgcggcatacaaagactcagatctccaagatgaaccggaacatcagccagctccaggctgagattgagggcctccaaggccagggggcttccctggaggccaccatcccagatgctgagcatcgtggggagctggccgttaaggatgccaatgccaagctctccaagctggaggccactctgcaacgtgtgagtaccaggagctgatgaaagtcaagctggcctggaaatggaggtcgccacctacagaaagctgcgggagagctaggagagccagctggagtctgggatgcagaacatgagtatccatacgaagaccaccagcggctatgcaggtgatctgagctcggcctatgtgggcctcacaactcgtgacctcagctatggcctgggctccagctttggctctggcacaggcttcagctccttcaggtgcaccagctccaccagggccgtggttgtgaagaagatcgagacccgcgatgggaagctggtgtctgagtcctctgacttcctgcccaagtgaacaactgtggcagctcctcctagtctgcccctcccgtggctgccacagactccaggagggaggctgctgtgtggggaagcacagacaacaggagaccccccacctgaggctcaacccacccgtgggggagtttactgtctggggaccccccttgcccatgcttccagctagaaaacaattgtggttttttttttggtccaaaataaaacctcagctagctccaccacaaaaaaaaaaaaaaaaaaaaaaaaaaaaaaaaaaaaaaaaaaaaaaaaaaaaaaaaaaaaaaaaaaaaaaaaa

SEQ ID NO: 314 - DNA, 2051 bp, Homo sapiens
gcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgctgccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcacctccaccgcagccctgctgcttctgaggacttaggtattttaagcgaataaactgacagctttgaaaaaaaaaaaaaaaa

SEQ ID NO: 315 - DNA, 1035 bp, Homo sapiens
ttttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgttaaaaaaaaaaaaaaaaaaa

SEQ ID NO: 316 - DNA, 3758 bp, Homo sapiens
gggctgtgtcatccgggattgttggaattttgcatgtgtctgttccatatcccgctggtaaccagcttacagaccttctgtcaggttggcttacattatcatcaacaggttgccgtagtgatgatatgatgctggacacaatcattgtgcactttgttaatttggtatggtggtgccacacattatcactgtacagcattaacaaggctggaatatggccctctgctgtagggggcgtggcacctgtgacttgcactggaataagtaggaggctttccccaaaggatatggagactgatgtgtgctccatatcttgaggggagctctcttggtttcctttggccgggtctgttagttacttttgaaggccatgccaacccttttaggccattaaatttttctcaaacaatagccagcctcatttctgcttcatctctgtggtaggaaccattccctactcttactccctcctcttgtccaacttccaccaaacactcaatccgagtcctggctgctttcttgcttaggtctgtggctggtaactgtggtgaaagagtcaaggtgggcagtgtttggggtaggaaatgagtagtggtgaagcagcagcagtgtgtgtgtgggtgtgggtgtgtgtgcatgcgtgtgcatttgcatgtgtgtatgttgacaaatgagagtgtagccataagatttcattgttactactagtctttgtgtacctatctggagggacattaaaaaaatatggccattctcccatctagggggttcccatctcagacttctctgataagagtaatttgagaacaaatacagattcatctatgggaaaagatgtttaaactcagcatgaaggagaaacaaatttaggagtggaaagcaaggcaggtagttaggtgatttccatgaccacatttgcttgggccagggaagtggtgcacctcttttataacaatgggagatttcagaaacagtttgagtgttggcagaccaatgccctgataagcttgtggtatagaggtaggaagggagggaggccagagattagataaaatgatggtgggtgggatcttagctctaaatgaaaagaactggacttactaagtgggtggattacttgctagccataacttttagggaagggtaggtctggagagaaggtgaagaccagcagaaatatactgtgaaattgccaaatatgtttggttgcagaaaacacagcctggctctttgtggctagatgtgacttccaacttctgaagacaggattgccaagagatgtgatctttccacatacagctcctgtccccatctctttatgtgtagagacctggatttggggtagtggggtagtaaaccatatatttccaaaagatggtgtgaagagtcgtttctcttcgtctgggatgtgattggcttttgttttttgttttttgtttttgagacggagtctcgctctgtcgctttgtcaccaggctggagtgcaatggcacaatctcagctcactgcaacctccgcctcctggcttcaagtgattctcctgcctcagcctcctgagtagctgggactataggcgcgcaccaccatgcccagctaatttttgtatttttagtagagatgggatttcaccatgttggccaggatggtcttgatctcttgacctcatgatccacccgccttggcctcccaaagtgctgggattacaggcttgagctactgcgcccggccagtgattggcttttaaattaatcacaaatgtttgataaaattctggtatgtgctaagtcccaggcttggttgatatctcagactatgatagctgtgaccttcaagaaatttctggcttggggaatctgtagtttctggttgtccaaaaaagatagttcttagtcctactttattttctacccactcaactctccagacttccctcttagtaaaggaattcataattctccctgcatcttctctgtttatttcaatgtccatgttctgagtctcaagttttcctgaagcacaggagcaggcttggccccagagcccctggctttttcaacgagcatcagaaatgctatcaatatattctctctgttgctttatcagcttctctaaatttattttgtaaggaagttagcacctccttccaggactttaaacagttgtctttgccaatttgttcctggattttccttgaacttctcaggtttccaagccacatcctagcagggcatccaggagccttgcactgaacctctcagctcttttgactttcttctggtcataggtgttgggcctcccattaggtagaagtcctttgagcagacccgaaatggccaaatgagacatcatccaagttcctccctcctttactgtctcggctttttcaagcacccctttcacctctcttttctgccttttcctcagtctgtcaagttctttggaggaaagaagttcttggtcagaggtcctaaaaccaccaccagctgggggtgctgagaatggtgaggagttggacagtcccggggcttttttgaaaggggactttatggtcatttcccctgtttagggtgagggactaagaattctcaagccttcagtttcatccatatttcaatgtaagcagaaaagcacatctcaaagccaaatagaaatgattttctactaagcctatcctttgtgattcttggttcccttggtctcttaatattaattatagagaatgggcagttgagtcagttaacatcttttcatcagaaaggagggtaatattcataaccaaaagagatgtaaaggaagtatattactgcttgaagtgtgaaaagaggaaaggagtgttatgtgaaccttttcagtagggaaattcagaaaatggaatgattcatccataggcataattcttttaggagattctgtgctcaaagggaagggaatggtttctgatccttctgaagagaaaaggaatagcatttttcttaaacctaacccagtttcagcattggagaatacagaactttttcttctagctgatggcattaatatttcttgagagagagaactcacccatggcacttttctgagcccagcagaaatcagcggagcttgggcttcgcttagcaggtttgcaattgacttcaacatgcaggcttttcacatgtgcaataatgctggaaacagaagcaccaaactgattgtgcaattactccttttgtagaagaggccaaaatcctcctcctccttcctttctcctatattcactcctccaggatcataaagcctccctcttgtttatctgtgtctgtctgtctgattggttagatttggctccccttccaagctaatggtgtcaggtggagaacagagcaaccttccctcggaaggagacaattcgaggtgctggtacatttcccttgttttctatgttcttctttctagtgggtctcatgtagagatagagatatttttttgttttagagattccaaagtatatatttttagtgtaagaaatgtaccctctccacactccatgatgtaaatagaaccaggaataaatgtgtcattgtgataatcccatagcaatttatggtaagaacaagacccctttccctcaccaccgagtctcgtggtctgtgtctgtgaaccagggcaggtaattgtgacactgcatctcatagaactctgcctgcccagatttttgtgtgctcacctcaatgggtgaaaaataaagtctgtgtaaactgttaaaaaaaaaaaaaaaaaaa

SEQ ID NO: 317 - DNA, 2295 bp, Homo sapiens
acgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaccgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttcttttttgccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactcactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttttactgggaggttcatcaaaccttccatttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgccttcagtttaaaaaaaaaaaaaaaaa

SEQ ID NO: 318 - DNA, 1721 bp, Homo sapiens
ttttttgcttcaaatgatttgcactaattgattttctggagagcggagttacgttaacaacaaaattcttttatagttcctttgatactatttcaaataaggattacacattgaaagtttttatagaaattatgaaaattggataatcttaactatggtaaccattactattatccatactactttctccccactgaactttcaaatttgaaaattggggtagcttttgtaggtcactttcttataaagatgctgatggtcacagatctcctaagtatccagaataatatttttatcatgagaaggattccacacaaaattggggtcttgcaccccatatttcagaggatctgaacagaaattgtggcttcattgcacattttaaatctctgtagattcttgaaatcacccaacctctcacatttgaaaacccaacggcctggagtattctggtggcactggagccagcactagctttttggaatccaagtggggagagaaacaaaaatagacttttcaagggactgtcccagactacccagggcaaatgtcttcccttcccttcctgaagccacaggaaagcaccctggagtcctttgtataccactatggaaatttttaaggcaagctctcaagacttgaagagttggaattctcggcatttaaatgatgcctgaagtttgttttgaaaaagcaatatttcattgctcttttcaattgtgaagcaactgctcagcaaatattactcatttttttaaaaagttgaattaaagggaaatatatttttaaaaccaaaatagatcaaaatgatcccagttttaagggattttgcctattttggaagaataaaactaaaatgttaaaactgttgaattacagagaacagatgtactctgagacataattttaaacaaatatttaaaataaggcaggttaacatttgcgtttaggcaataaatctgtattaaagggaagcacatcaaggaaatatatacatgttgaataatgtaactgaaaaatattttttaaaaaccacttaaaaagaaaaataatttgatgggtactttaggcattgtagatagaaattaatgtataatagtgtcctcccagtctttgtatgaaaaattaaaactctctagtcctttaatgagcatgaatttatacttctacatttgttgcttagtaaaattatactcagtactttgagttattcagatttatgtttaatattgttaaattcttcatcagagagcataaatatattgtcttctatactttgtaacttgtgcatatctaaagaaactaacaacgaacattttgggagatgtttttgtgtttttttatagtagagttttagagtacatttgtcttaataggaagtttttaccataaacccaagattttatttcacgtattgttgctttctcttatatggaacttattgtgtacctcttacctttatttctaatcatttagtgatactaatcttttcatagtaaatatatttgtttctaattgtattcctagagtttacattcctaaagaataaacgacgactttggctatttttgtgtgttccctaccttcttaaggctatggaaataaactggagtttagttttttgaatttttgtatatttgtgtaaatgttctccatatgtagtacttgttatacaacaagtgttgcctcttgttttattgaaataaaaactgaaaaaaaaa

SEQ ID NO: 319 - DNA, 1642 bp, Homo sapiens
tcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaaagaaatggcacagttttttgtatttttttttttagttattttttgttgttgttgtttgtattgtttctcttttctgatagagtatggccacttctgggggaaaaacatgtaattaagtaaatgtatacattggttttcacgttttacttttgttttcccactaccaataattttcctctggaagaattttatagttttttctatttcattttaatgagtaacaatatgttaaatgcataattaagacaaagcaatgaaattctgactttattcaaagtactgaagattattgcttctagggcatttttaaacagcaccattgtattgttgaatgtttatgtaactgatggcttttctataatgtaatttttgaatgttcaggtgttacatttccaaagtttaacttttaaaaaaccatcttctgatcccttttattgtctgggccatacaatctatattacataggtgccaacatttaattcttttaaatggaacatttgcagttttccatattggtacctgctttttctggagaggtttgagatcttgttaacaaatcagactttacactatatacagatgtgacagataaattgaaccacttgtttgtgaaaatgagttcctgtcatcttcctcattcactcagccctcaccccagcagccttttccggtcattgtagctgacatggagcagtgacagtattcatttgagaacagggatgcaagtcacagacatcataaaatcagggtctccctgctgaagcattcactagttggcaactatgaatttattccatgtcattctgtttacttagcacttgcactacccttgttggttgagtgtatgctttatttgtttctagtttgaaatcccacatctgatagctgagagtaggcaaatacaacatttacctaatgtcattcactaacatggaagagttgtgaaaattctagagtgctgtaaatccttggcatacactatgacaaacaacttcattactctcccaccaggagctgctctcctgcacttagaaataatgtcacaagtagttttctaatgtacaatgcagacaaatgtactgctctctgaatacttgaagaaatggtattatacatacatagaaacttattagttataccttttcacaatcttattacgatgttgccgttaaaagggaaaaaagacacaggcaatgaatggtgggatagtaagaggacttagagtgtatgaatgagttgattttacttttttggaatttgattaagttgacagtaggcactgattggatgattaaacataagttaatctccactgtgataaaaacttaaataataaacatgatttaaaatagaaaaaaaaaaaaaaaaaaaaaaaaaaaaaaaaaaa

SEQ ID NO: 320 - DNA, 1537 bp, Homo sapiens
cctaggccccgtgatcaccaccccctcaagcggggccccagccccctgagcaccccctcacgtgacccagccctcggctgttccaggctcactgcccatggtgtgctcttctgggccacagcagccagggctccagggcgaggacaggggacacctgaaaacaccccgttgttcatggtcttgtgcccattcattcggagactcctgaaaaactgggctgtttgcaaagcaaatccagctccttgtcctagcaggttctcagaacggggagtcccctgggatggagctgctcccctcacggcagcaccacgtttccagtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagacctttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgtgtgtgttttgattttggtcttttatctgttttatattgacataattttcctgtttaaaaaatacaactttggcttgttaaaaaaaaa

SEQ ID NO: 321 - DNA, 1379 bp, Homo sapiens
gcccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatgcattgatcttgatgcccatcagggcaatgggcatgagcgagacttcatggacgacaagcgtgtgtgacatgcatggatgtctacaaccgccacatctacccagggtaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaagcagagcctgtgtcccaggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctgaatgtgaggggcggtcaggaaggggtacaggtgggttccctcatctggagttcccctcaataaagcaggtctggacctgcaaaaaaaaaaaaaaaaaaaa

SEQ ID NO: 322 - DNA, 1071 bp, Homo sapiens
ggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtaaaaaaaaaaaaa

SEQ ID NO: 323 - DNA, 2480 bp, Homo sapiens
gagatttgctggtgaagtcagtgacgaaaaaataaaccttcccttatcttcctactctgcccctccccctaatgaaatcatattaagttgttttttttttttttttgtaatatacagctttttttttaaggcatcattttcgagggtctaaaattatctggtaaaacaaatgaaattaagtgatccaaagctgctgaagtatgtttgaactctccagtgccctatagctgcaagagttgaattagtcatgcagtcatatggcagcaggttggtgattcagtccgaccttctttaggtaaccgagcatttatttaaccaactataccactgcattgggacgtctgcacttgagcttctacaatctgatataaatctgaatacaggattattctgtttgaaaactttgctatgtgtgaactgtaatacttgatacatttttggtttgaagactttgtctaagcctcattatactgaagttgaagaaaccaaatgagctccaccctcactttgcctgccctgatatgatcacttgttgagtcactggagttcctttcattttggcactgatgctgttttctcttgtctgatttgaaacagtactggtaataatatggttgttgaaaatgtgatcacctttatctaaagtgggagaagatacatacacagtatggcaaatggataaaatattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatagttaaaatctaaaggatagaatgctttcctaaaacagaacattagcctttaaggttaaatagactttacattgtatctaagttaatctttataaagcactagaatttttggtcaaaagtcaaaatagtattagaatattgaaattattgatagctttcataatctcagcttttttgaacttccacaatttttggaatatgtcataatttttttccctgtttcaaatgtgttcagaggaaatagaatgtaaaacatcacaaaaaaaattgcagtacataaaatttctggactatgttagttacttgatctggaagtttaaaatttggactaaaaggttttattgaaataaagcctcttaaaatgaaaaatcatatacttttaacatcacttttaagctaataaatataagaattcttttggaaattagaggtggaaacacactggaacctcatgataattgaccctctggatcaccagattagtttaatttaacagatatgtccaaggaagttgagctatagggagtaagaaaaagcatcatgataacgtctagtcaataacatggcacttcagcagagattcatagatgatggtatgcccatgcatcatttgctcttcaaatatctatgtgcttggagccacagtttcctaagcgcatagtttttggtcctgcctcatgtaaaatagttaatgattatcatttacttggaaagattttacctgtgaagtgaaattctttcattgggggtaagggtatgaggtgatcaggaagtttcttctggaattttatcaagtccttgtattctaaaatagccaagcaaaatgatagtaaattctttgtctttgttctttcagtcagaggtatttattaagtacctactgtgtgctcagcactaaaggtttgttgataaaatgacaattaaaaaatggcatttagccaaaggccttttcagccaggagtaagaaaagatggttagtgatatttggaaatacctggatatttgctagaggaaaaatgaaagcaaaacttcgtacacagtgccttgcccataataggtactcaataagcaattgttcctcatagagtcttttgccatgatttatggtgttttttgaaatttgtcttaattgaaaaaagaccaaatatttcaaatgagcttataggcagctgtggccagtgaaaatatggggttgtacagttagttcctagaatgttattttgcactagttgtcacttagaaagatggggttcctgtagattttttggtgctaagggatactttgtcattatgatgaagtaagtgttaagtgtcagataaatagcacacagaatagttctttctgctggtctgttttttctcttcgttgttgttgtttttaattgtaaattgttatcaatcaaactattgtagcagctacaaagtaattcaccagcatgacaaaatggtcaaaaaataagtcatcagcacttaagaaatgaaagcaacttttgaaattttctgttaaaattgtcaaatatattttatgaagaatttataaaaggggaaaatgattgtaatttattgttcatgacttttttttttaaataaagtgagtttcaacaaaaaaaaaaaaaaaaaaaaaaaaaaaaaaaa

SEQ ID NO: 324 - DNA, 2691 bp, Homo sapiens
gccacgctctgacctttgcctctcctctccctgcagatctgggtaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcacggaagatcagtgtcaacgccaaggatgaggaccagtggacagccctccactttgcagcccagaacggggatgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccgtgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacactcctgcggcgaagcaagacctagctggctgcctgcggagaccgggggtccacgtggggctcttgtcctgtcctgtgttcctcgtggggatggaacgatcctgcgtggggccccgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatggctaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctaaaaaaaaaaaaaaaaaaaaaaaaaaaaaaaaaaaaaaa

SEQ ID NO: 325 - DNA, 1740 bp, Homo sapiens
gcgagcttggattgcccggtgccccaggaatcgatggagagaagggccccaaaggacagaaaggagacccaggagagcctgggccagcaggactcaaaggggaagcaggcgagatgggcttgtccggcctcccgggcgctgacggcctcaagggggagaagggggagtcggcatctgacagcctacaggagagcctggctcagctcatagtggagccagggccccctggcccccctggccccccaggcccgatgggcctccagggaatccagggtcccaagggcttggatggagcaaagggagagaagggtgcgtcgggtgagagaggccccagcggcctgcctgggccagttggcccaccgggccttattgggctgccaggaaccaaaggagagaagggcagacccggggagccaggactagatggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgctcccgcaaaactctggagtccctgggacacaccctatccaagaagacccaggggtggaacagcggctgctgttgctcctggcctcatcagcctccaaactcaaccacaaccagctgcctctgcagttggacaagacttggcccccggacaagactcgcccagcacttgcggctgggcccggggagcagtgagtggaaatcccccacgagggtctagctctaccacattcaggaggcctcaggaggccagcctgccatgagagcacatgtcctctggccaggagtagtggctgagctctgtgatcgctgtgatgtggacccagctccagggagcagagtgtcggggatggaggggcccagcctggactgactgctacttcctgtctctgtttccattatcacccagagagggacaagataggacatggcctggaccagggaggcaggcctcccactcagagtctgggtctcactggccccaagtctcccacccagaactctggccaaaaatggctctctaggtgggctgtgcaggcaaagcaaagctcagggctggttcccagctggcctgagcagggggcctgccaccagacccacccacgctctgacgagaggcttttccacctccagcaagtgttcccagcaaccagctccatcctggctgcttgccttccatttccgtgtagatggagatcactgtgtgtaataaaccacaagtgcgtgaaaaaaaaaaaaaaaaaaaaaaaaaaaaaaaaaaaaaaaaaaaaaaaaaaaaag

SEQ ID NO: 326 - DNA, 4060 bp, Homo sapiens
tgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggaaaaaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatcttcttctcactggtgaaaacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaagcatgcttgtggggcattagaaaatgagatttttttttttttaaagcagagcctcctaagaacatcaaagttggtcctagcaaaatatataaagtccctaaagcaacttatacttgaaactttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctggttggtgtttaaggtttgagcctcccaagggtctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgcactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaacttgtaaaaaaaaaaaaaaaaaaa

SEQ ID NO: 327 - DNA, 1200 bp, Homo sapiens
cattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaaaaaaaaaaaaaaaaa

SEQ ID NO: 328 - DNA, 2498 bp, Homo sapiens
gctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctgaaaaaaaaaaaaaaaa

SEQ ID NO: 329 - DNA, 3656 bp, Homo sapiens
cacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtgagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccctagacctgctccccagaggaggggccttgacccacaggacgtgtggtggcgcctggcactcagggacccccagctgccgcagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaagccaaaaaaaaaaaaaaaaaaaaaaaaaaaaaaaaaaaaaaaaaaaaaaaaaaaaaaaaaaa

SEQ ID NO: 330 - DNA, 3619 bp, Homo sapiens
attagggataggaagagattttcacatggcagactttagaattcttcactttagccagtaaagtatctccttttgatcttagtattctgtgtattttaacttttctgagttgtgcatgtttataagaaaaatcagcacaaagggtttaagttaaagcctttttactgaaatttgaaagaaacagaagaaaatatcaaagttctttgtattttgagaggattaaatatgatttacaaaagttacatggagggctctctaaaacattaaattaattattttttgttgaaaagtcttactttaggcatcattttattcctcagcaactagctgtgaagcctttactgtgctgtatgccagtcactctgctagattgtggagattaccagtgttcccgtcttctccgagcttagagttggatggggaataaagacaggtaaacagatagctacaatattgtactgtgaatgcttatgctggaggaagtacagggaactattggagcacctaagaggagcacctaccttgaatttaggggttagcagaggcatcctgaaaaaagtcaaagctaagccacaatctataagcagtttaggaattagcagaacgtgcatggtgaggagatgccaaaggcaagaagagaagagtattccaaacaggagggattccaaagagagaagagtatcccaaacaacatttgcacaaacctgatggggagagagaatgtggggtggggatggatgatgagactgaagaagaaagccaggtctagataatcagtggccttgtacaccatgttaaagagtgtagacttgattctgttgtaaacaggaaagcagcacaattcatatgaatattttagaagactcccactggaatatggagaataaagttggagatgactaatcctggaagcagggagaacatttttgaggaagttgcactattttggtgaaaatgatggtcataaacatgaagaattgtaggtgatcatgacctctctctaattttccagaagggttttggaagatataacataggaacattgacaggactgacgaaaggagatgaaatacaccatataaattgtcaaacacaaggccagatgtctaattattttgcttatgtgttgaaattacaaatttttcatcaggaaaccaaaaactacaaaacttagttttcccaagtcccagaattctatctgtccaaacaatctgtaccactccacctatatccctacctttgcatgtctgtccaacctcaaagtccaggtctatacacacgggtaagactagagcagttcaagtttcagaaaatgagaaagaggaactgagttgtgctgaacccatacaaaataaacacattctttgtatagattcttggaacctcgagaggaattcacctaactcataggtatttgatggtatgaatccatggctgggctcggcttttaaaaagccttatctgggattccttctatggaaccaagttccatcaaagcccatttaaaagcctacattaaaaacaaaattcttgctgcattgtatacaaataatgatgtcatgatcaaataatcagatgccattatcaagtggaattacaaaatggtatacccactccaaaaaaaaaaaaaaagctaaattctcagtagaacattgtgacttcatgagccctccacagccttggagctgaggagggagcactggtgagcagtaggttgaagagaaaacttggcgcttaataatctatccatgttttttcatctaaaagagccttctttttggattaccttattcaatttccatcaaggaaattgttagttccactaaccagacagcagctgggaaggcagaagcttactgtatgtacatggtagctgtgggaaggaggtttctttctccagttcctcactggccatacaccagtcccttgttagttatgcctggtcatagacccccgttgctatcatctcatatttaagtctttggcttgtgaatttatctattctttcagcttcagcactgcagagtgctgggactttgctaacttccatttcttgctggcttagcacattcctcataggcccagctcttttctcatctggccctgctgtggagtcaccttgccccttcaggagagccatggcttaccactgcctgctaagcctccactcagctgccaccacactaaatccaagcttctctaagatgttgcagactttacaggcaagcataaaaggcttgatcttcctggacttccctttacttgtctgaatctcacctccttcaactttcagtctcagaatgtaggcatttgtcctctttgccctacatcttccttcttctgaatcatgaaagtctctcacttcctcttgctatgtgctggaggcttctgtcaggttttagaatgagttctcatctagtcctagtagcttttgatgcttaagtccaccttttaaggatacctttgagatttagaccatgtttttcgcttgagaaagccctaatctccagacttgcctttctgtggatttcaaagaccaactgaggaagtcaaaagctgaatgttgactttctttgaacatttccgctataacaattccaattctcctcagagcaatatgcctgcctccaactgaccaggagaaaggtccagtgccaaagagaaaaacacaaagattaattatttcagttgagcacatactttcaaagtggtttgggtattcatatgaggttttctgtcaagagggtgagactcttcatctatccatgtgtgcctgacagttctcctggcactggctggtaacagatgcaaaactgtaaaaattaagtgatcatgtattttaacgatatcatcacatacttattttctatgtaatgttttaaatttcccctaacatactttgactgttttgcacatggtagatattcacatttttttgtgttgaagttgatgcaatcttcaaagttatctaccccattgcttattagtaaaactagtgttaatacttggcaagagatgcagggaatctttctcatgactcacgccctatttagttattaatgctactaccctattttgagtaagtagtaggtccctaagtacattgtccagagttatactgttaaagatatttagccccatatacttcttgaatctaaagtcatacaccttgctcctcatttctgagtgggaaagacatttgagagtatgttgacaattgttctgaaggtttttgccgagaaggtgaaactgtcctttcatctgtgtatgcctggggctgggtccctggcagtgatggggtgacaatgcaaagctgtaaaaactaggtgctagtgggcacctaatatcatcatcatatacttattttcaagctaatatgcaaaatcccatctctgtttttaaactaagtgtagatttcagagaaaatattttgtggttcacataagaaaacagtctactcagcttgacaagtgttttatgttaaattggctggtggtttgaaatgaatcatcttcacataatgttttctttaaaaatattgtgaatttaactctaattcttgttattctgtgtgataataaagaataaactaatttctataaaaaaaaaaaaaaaaagg

SEQ ID NO: 331 - DNA, 1489 bp, Homo sapiens
ctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgcaaaaaaaaaaaaaaaaaaaa

SEQ ID NO: 332 - DNA, 2746 bp, Homo sapiens
agctggggctccgtcctcgcctcccacgagcgatccccgaggagagccgcggccctcggcgaggcgaagaggccgacgaggaagaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaaaaaaaaaaaaaaaaaaaa

SEQ ID NO: 333 - DNA, 3091 bp, Homo sapiens
ctggcaccgaggccaagacccccaggctcatatccacagaaaccgggaagggaacactatccctagtttcttcaactggttttcagaccacagccttctagaattcgacagaattgcagagattatcaaaggagaactgtggcccaatcccctacaatactacctgatgggtgaagggccccgtagaggaattcgaggcccaccaaggcagccagtggagagcgccagatccttcaggttccagtctggctaatctctgtcctgtgagaagcttctgcacaagtttccttaccacctcctcttggacctatgcttggccaacagcatgcagtcttccatctgctttctcttcatactgtggattatcttttcctttggttctaaatcttcagtaatcggttgcaagattgttggcttacctgcctgtgccattcttcctctgggccttcatgcttttctgcattgtggttaacatgtttcaagtgcatggccttctacggcttctatgccaagcgtatgatactatagatatagtgtaccatactgcctttctttgcatggcttggaccctatctgtgaccatgctcttctcccaatttaagtggttctgtaccacaaagaatcttgatacattttcacaaataactgattgggcttcatactttatgctggctgtgtcctgatacccatgtacttatggtaagctatttgggtattaccactgcaagacaaaactgatatcttaacccggccatcaacccaaattggacattccagactaccaccaactggatcccagctgccttcctgggcttgtgccatccaccctactggttatctgatagaacaagctggtggctgatgggtgactgctaggcgtgactgaggtaatagatgaaaagtgttctatgttatcacattggttttcctgtacctttggttactctacgtcatgaccagctgctggtgagtatgaagcctgtgctatagcccacccctactcactctcaccttctggttgaactttgcttaggccaccattgtctgcctcatcaggaactatctgtagacgtagctcccagggagctcacagcaacaccccctaccaccaggatgggcagtaatatgtgacagagcccaaagcaaggctggaacgcagtcccttccagcttagtctttctgactcctagccaacaaaccatccttaatgtgagcaacttctttaggcatttcctcttttccccgcctgcacccactctgaacatgacaaaagttgccagagttggggcattgaggaagagatatttctggaatgtgagacttgttatgcctctgtctctttctctccctcctcctcccctctccctccccctctccctcccatcccttttcttccctttcactctgaagcagttttagcttattaacagaaaacaaaactggcaaagcaggctttttgtttaatttgctctttccctgattgtgttcagagagaaaggttatgattaaatgggctccagatctcttattgcccttattcctccaccccacttcttttagcaaggtctgaaagtttcaaagggagacctataggttaattgtttagttataggcagtgttaaattaggcagattttgacatatttatctttttaccccatccattctaccaaaacctgtgtatttcttgagtttttagtttgagaagctggaaagagagagaagggcctcacagtgatgggttcaggacgggtcaaaggcaaaggcctttgtgatgtgagcaaaggcaaccaaaacttagcctcactccacttttctaaagatggaaattcttttttgggccttggactgcttctagggtagcattttgtaggtcactcttctcctttgtactattttgtttctgccctgatgtcccttgggtctccatcctactgcctggctttcttggccctcatttctcagcttctgcatttccttccctgctcctaacaaatgaagaagcaggctgcagcctgcattgtggaagatctccagcctccttgtaggggataaggggatgtgcagcatctgtgtggattttcacggacaagttccagtaggtgggacagtgatgccgtcaaggcttagttatgatcatgtgtggtgataaagaccatccaccatcacccttttcccctttggttttgaaggccttgccctaagctacctgagggtttaggaggtctgaacacacacagtggagaggttaatctaggttgggaaactgagtaaaagtccagagcaggaatgagcctgctgtggcgtgggtttggaaaggctcacaggaaagaacctgcaggatcaggggtgggaggggaggcccctgaggtgctctccagggaagaggggctggggtttaaatagcatgcttggaggaagattttccttcaatttttcctaagtccttgaattcaccagtagatttttgtaaacaaaatgtaagtcgatgttttctctcaattatcctaggagtgacctttatatgtgtggaagattaatggtatatgctccttatgtcactgtttttgagtaaaatccatttcctttctctgtttcagcctatgacaaaattgatgtttacaggcctgctttttgcttataattgacaacatgtgcaaaaataccaaatttgtgtcctgtgcagtatgaagaattcagtgaatattcattaatgtattagcttgttttgctctctgttcatatatggctctattcttagaaatataatttgaatgtgatctttcaatagtctgaatattttacaaattatagctatgtcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggaaaaataaagtgtcactaccgtatttcttgttttcatcaaaaaataaaaataatttaaaaaaaaaaaaaaaaaaaaaaaaaaaaaaaaaaaaaaaaaaa

SEQ ID NO: 334 - DNA, 2744 bp, Homo sapiens
tttttccagtatagatagaaggggcctcatgcactagcccaagttctctgaattaatcttagataaattaaatactttgtaaatattttaatgattataattgtaataaaattattattttttctgttcctcagtggcgataaagtatttaacacttatctgtctttgcagacaagcatgaaactaaattgaaaggagtaatatactttcaagccattgaagaagtctattatgatcacctcaagaatgctaataaggtaaacatcagttttctaaattcctacagtttgaatgcataattaagaagggaaaaatatttttggagtctaagaagtttgaaattgatgttctgatgtaacagatagatatgatcagaatggtgctggaaaagtaaacatgaagtaagtgggatggccgttctttttgaggaaaaaaaatatcatagcaaattgaggaaatattctggacataatggtttgggaaaccctgcgaaacgactctgccagggttctaaaaagaagctaccatatagttaagagggggatcgtgagcaagtcctagtagggctaagaataacagctactatttattaaactcctactctcagctaggtaccctgctagagctttacaaactagctgctgaaataatttatgagttctgtctgagatttcctgttcagaaaaatggtcaatcctgaaaaaggctctgggacaggtgtgtgagttatagtagagcaaaagtaacgcctttgtaaatttaataaattgaaaattttgaagaagtcatcacatgtctgtgttatttaatgttgtattttaagatgtttattttacattctttttccttttttgaattttagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttcttataaactgtttttaatcagttgtcggatttggtgaaataaactaaacaggttacagaatatctgtatgtacttggaaatacagaataactttatcacccacatcattggcattgacattattggtaatcaactggcttttttttaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatatatatatatatgtagtaaaccactttttgtaaaagaagaaagagcaaaaagctgtgcgttttagaaaaaaaagccatgttacacaacagacattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcgacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacatatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaaaaaaaaaaaaaaaaaaaaaaaaaaaaaaaaaaaaaaaaaaa

SEQ ID NO: 335 - DNA, 1252 bp, Homo sapiens
aacctatcataggcactaaagaggaaaagcctttgaagcaggcattagtacatgcagtgttataattcatatgaatatgaggtacaaaagaagaggtgttgatgttttaaaaacattaatggctatttattgatattgcagaccacctagaggatgctaaattgaacatttagtgacagaagattttctcctggatactttaaatacataaaaacttggcagagtttttatgaaatataaattttattgtattcatttacatattaaaaaatagactcagaggcggaaaaacttccttgaaattgtttgtcatttgttctacagttacttactgaagtcattactatttaccaagcatcatgctaggtgctaggcttacaagagtgaacaaggagacagggttcctgtcattatagagcttaatctactggggaagattgagtgggaaagattgacttaaataaaacagtaagttcagaaagttaggaagtgttggagtctatatttaaacttaggtattttgacccaaaagcctgtactgtttctaacataccatgctgatgctctagcctccattttatatgcttaaacttattatggggcttttaaatagaatatgtattatccttgccagggcaaaatataaagaaataattgactgcctgctatatctgtcttcacctttctatccctattatctgtttttttattcctcttttttgtctcccttgtttcttaccctgacttatgtatgaagatctctagtatttctttactattgtgaggatgaccagcggagaggctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataaaaaaaaaa

SEQ ID NO: 336 - DNA, 2273 bp, Homo sapiens
gggggccagttaccatattgtccggagtgggtccttgacattcaggaaagatacatcctcagacctttcaaaatttgtcatgcctctctaacctaaaacagccctcattaaatgcactttaatccgagcactgtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaaggtttgtgcctttttaagaaacatttcatggctctgatcttcagtgctaaaagactgaaaattataccttttatttgtatgtactttccactttctcacagtgttttcatacccaatatctcattttaaaaataaagagagttgtaggatattaaaaaaaaaaaaaaaaaaaaag

SEQ ID NO: 337 - DNA, 2053 bp, Homo sapiens
ccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggaatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgcctccgaaacctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcctgagtgggtgctggttgctgtgtcttgtctgtaaataaactcctatcatgcctttgcttggagtctgtgatccatctgatgctgcccccacccccacagtcctattttcccagctaaagaccaggagagtctccggctggctcccaactggggctttgcatttctctagagttcatctctgagctgtaagggtgaccagggggcagggggacgattgtgtatcagctaggctgcttttggctgcaagtaacaaaatatcagatacaaataggcttaaacattaaagagatttgattagttctttaaaaaaaaaaaaaaaaagg

SEQ ID NO: 338 - DNA, 3658 bp, Homo sapiens
ccaggatctcctctgggggagttttctattaccagaaacttcattacatcagaatccaaactcatgatcctctcttgaaaacagacactcctcttgagctcctgggctttctcgtttcctcctttggtggtgccatgacgctcccagctgccctggcctgccatccttgctttgttgtgtccccagacacccacagtcagcaagtcctgctgaatcttcttccagagagttgttgaattccagcctgggtgacagaacgagactctgtctgaaaaaaaaaaaaggaggaatgatactacctgttaatgatactacctgttaggattattggggtattaaatgagatgatttgacaaagtgccatttaaagtatatagcattagataaatattttatcttttgtggactttaacaaatagtttattgatggaaattttttaaaaaagcttttaagttacacattttaagttcctgctactgaaagcaggattaactagtctgtagaataatagtaattttttaattttgtctccttagctcattacctaaaggacttattgtaaataagctatttaagatcttaagaaatactgtatttttttaaatggaaggctaagaaaaacataaacagcctaagcatgtgcattaaaactttgttgacttataagattattcaaaatatgttattttaattttggaattatattgtttactttaggcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggacctttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctcatgcaaaaaaaaaaaaaaaaaaaa

SEQ ID NO: 339 - DNA, 3485 bp, Homo sapiens
cacaaagaaaaaagaaatacctgtagaagcgcatcgaaagctcctggaacagagttgtgtctcatatttgcaaagatgcagaaaaaataaacccgggacatccagctttcttttcctttcttctttgactattctgagaagctatgcgactaggagcacattttaggtaaacacgtggcttgagtagccataaggccactcttccctgtcgtgtgacccgcgcctgggcctttaagagatattggtgtttgaaaagggaggaatctgtttgccctcagatatttagttcaactgcctgcattgcttcctattttgttgtccaactctgtagtagttagcactggccttaccaacatgtaaagaaattttctttactgccccatgagtagttggaggcaaagagaaatttttaaagcgcagaaaaaggcctgcagggagatggaatttgttctgccagagaaacgagatgatagctgtatttaataaagttactgacctcttgtcaaaatttaaaacgcaaaagaagatgtttcaaaatgcagagaatgtcagaaaacaaaaactacagggaccagaccagtataatgtttagttttcattatactaacttttgtctagactggagttgattcactattttttctttaactcctcaggaagcaaaccttcccgatgatgaagacttcttgaaggatttcatgggtgatttgggatcccaggaccatttggctagtgtgcctaggtgaccacatgattgctgttttaccaggaatgcagcatcccattgacaaaacaagtgctctgagaaggtttaaaatactacagagaatatgggaacacagaccttgaaatttagctgagttgtaacagctgaaactccaagaggtgtcttccttgtttgaggtgaaactagtgttgcttccagagggcagctggaaaccgtaaagctgtttggaaatctttttgactgacttgctgacaaagaggtactgtgatgcattttaacaatatctaagttgatttttttttaaatcaaggaaaataaaaaccaagcatgaatgctatggtatgtgccccttttgaccatcctgggctgattaacatcatttaaatcaaagtaatcataaaaaggcatattctacttcaattatgtggtcaaataagagtaaacacacacactcacacatgctgaccccaattgccagagcattactgcactataaattacggttaattcccaaattatactactgtttatcttatttaacaagtcagaaagcacttttaaaataacttgagggctacaaggtcattctattaatgtcattctccattcgggttgtaggcatgtggaagtacccattaaaagataagttagagtttaaatactgataaacaaaaccttttattgcaactggacagtttctggagagttagcggaagaatcttggagtttcctttggtcagatgaatacaacatttcacttttgcagcactatttagaatgtactccatggttctcttgttcccaacttccaaaaagaacagaaaactttggtttacacagaacacgggcatctgaggcaggacctcttccctgccctttgatctgactcacacctccacatatgacgtaatcaacccaaatttgacaccaattcactcttttctgcaaagggcatattttgaaacaagggacagcctgagggcggctataatgagaatgttcatgggggttactgggtccctaattctgaacttgcttatgacacccagagtgaatagattcagattcagaaccttctgagaaataacccaaagaaaatttgttacccagccaattcttcgaaagcttaatatcaaaatatatcttttcaagaagaaaatcgttagagagaagaatgtggaggggagagaaatgggtttctcattgatatgatattttgttaaccatttcattttgaattattcaagttttggttaatattgtattcttttttcgtaactattttaccgtgagagtaggtcattgggttacttagatatttatttttacacagttattagtcttcagatagttttattttacttcatatgattttagtttttgtcagtataattttaaatcatgtttttcttggtcatctctttgtgtatattgtgtaattggattttcattgactgcaagtggagtgtttgccactcaattcagtactcagtactatggtgacttgttttcaaataagtctcagatacacatttagggagcctttgctggccgaatatagactctgtcaggacagcaggtcccctgatctaagaattttccccaatggttgctctaaaaatgctgctattttgctgttcactgtattgcacttagttaaaaagaagataatgtgaaagatgagagcagttttttaaaggatcttttcatatacccaattcccttattttcagatgtcccatcaattttagatatgaaagctttaagtaaaagtgtgtatgcctttctactgtcagaacaggatggatgcagcctgggtcagatttatttaagataaaaatcatgcagactcatcattcatatcataggtgaaaaatgtaaaaaccaaatggtttccactaaagccaccaagatcttttagaaatgtttgcacctttggtggtggcacaggaaaagagaagaattcagctggagtgaattctagaagtagatatcagaaacggggcatgaagaacaggggaactgggtggcatcagactcctaaagaagtgagttaattttccttcccttccattcagattcatgccacagctccatatcttgagtatgtgtaagaggtgagttccttcttcagccaggggcggtggctcatgcctttaatcccaatgctttgggaggccaaggtgggaggatcacttgtgccttggggttcaaggttgcagtgaaccatgattgcaccactgcactccagcctgagtgacagagcaagaccctgtctctaaaaatatatataaaaagtaaaactaaagaacttcttgcctaaacctgaattaccgcaatttgctgagtgactttgagaaaaatcagactgtttagttcagtcgggatgaaaagcttgcgattgcttcccacaagaatgggcaatagtgacggctgcaaggtacttttatttgttcatgaaagaacgacaatttttcaaaatgtaattaaacataatagaatgttttaaactactgggcactgaaactggaagaaaaaggaggctttattgaacattcccctttttcagttggttcaaagttcagcactgtggttatcattggtgatgccagaaaacattagtagacttagacaattgctatggcagtttctaaacagagctttttctatacactatttgcaactggagtgcaatattgtatattctgtgttaaagaaataaagtatttttatcatttattaaaaaaaaaaaaaaaaa

SEQ ID NO: 340 - DNA, 2809 bp, Homo sapiens
caaagtgtctagtagacagataaaaaaatagactagttctagatcgcgagcggcccccggaggctttcctggtagaagttgatgcgaggaagggcggcggggaccaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 341 - DNA, 3097 bp, Homo sapiens
agactatctttctagacaaggcagttgaggaggagggagcgcttgagggggactggcctggcgtgcactccgcacctcggggacattattgcgcgtggaacggctgcttttggaaggcacaacttcctgaatggaccatgactcccaccaaagatccctgtctctgattcaccaaacagcttcaaccctgaaaccaggacgagaagttgacaacatctgagtggacagctaattgacctaagacttcagaccagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatctgaattttgaaaaaccacaaagctacaaactgaccctctttttttttttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtctttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaaaaaaaaaaaagaaaaaaaaaaaaaaaaa

SEQ ID NO: 342 - DNA, 1041 bp, Homo sapiens
cggacgcgtgggctaaaggatacatcatatactgacaaactcaatgtggtcctttcaagaattagccatgagtctcaaaaaggcaataaatggctctaagtggacaggtttgcttcaaacaagtaacatctacattttgtctttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaagaaaaaaaaaaaaaaaaaa

SEQ ID NO: 343 - DNA, 2162 bp, Homo sapiens
ctgacacggatccagtcatacctggggctggatgggatttggaggccctggtcatttgcagagtgaatggtgaagggcgcggaaaaggtttgcttggaggaaagaccggttgcagaggcgaggcggagggaggaggggcggaggcagcaggtctttgtttgtggtaggtctctggcttccatcagggaggaggaaagaggctgtgcccttcctggctcttggctgcaccactgaggacgctccgagggacagcgtgctcacccatcctttgcacagtgctggccccaagccccacggccttccagctaggattttctgctgggctcatgcagaggcaggggacaggtgcatggaagagccgccccacccgacacaccattgtttgaaaatcactgttctctttactcacttaaaaaagtgtacagggaacacctgttcctggcataatgctccaacctcgcggaaggggccaggtgcccttcatctggctctggctgcttccgacctgggcccacgtcatcgttcacgtcctctgtgaccaccactggtcacggtgctccctggcccagcctccaacccacccagcaccctggcatctcccaggccagtctgctgcacccagcgagcttccagtcagaagccaggctgaacggccctcctgccccatcagcttcgtgtcttctttttttttaaagaactgaaatagtccccaagaggcctcatggcctgaagactcacaatcatccacctgtaatttatgataaatgtctgggagcatttaccatttgcgtccgtgagtatttatagccctgaatgggcgggggggagggggggtggaggaggccctgcagccaggagctacacacctgtccccactagtgtcccctggttgacagagccccctcagcctccccaaggctgtcactgcggctgtgacagctgaggagtgccgcctttgaaagccagtggacagtcgctccactagggggagaggccctggccctggcgcagaggaggcgttgcgaggcgggacgggggctggaggggctgagcagccttcagggcagggactgggccctgggtcactggagacgttgatattagtccatctgtctgctgccaaattgctccccaccacatgagccccaggggtttatgtcccaggaaggcgagggtgcccatctgagcggaattgggaggggacggcaccagctcatctccctcagggcctttgcctcctggtgctgccctggtggctgctcctgcaccacagcccctgatggctgctgctagtcctgagttgctgggtttacccccagcccacacttcccacctgggcctgagggtgcggccagtgccctagtcctagccactacaggagtcattctgagacctgctggaggccatggggtcttcccaggcccctcaatcagctgcttccagggtcagcagggcagggtgctgccagtaaggtcctcagggagcacagcccggccgcccaggctgggggatactggggcagagcttccaggtctgtggggcctgatctctccccaaggctctccaggccttggtgcgccctccacagtgaccttcagagaggctgcaccccctcagaagaacagtgagaaatctctccatcacacgctccctggtccttatgtccctgaggccacccttccccaccccccagtgcctggagaagcgtgagactctggaggggcgccaggaggccaggggtcctcagggctaggcctggagctcggcccaagagctgcttttgcgaagcctgtcttgaatccggattcaccagagaacaagagcctcccagcctttggcgtttctgggcctgtaaagatgtgtgtacctcccaggccactctgatgcaagggcagggaccatgccaggcctgggttgggaatggctctgtgactccagaagctccgtctaaaactccaaagatgcccaaaaggctgtgctgctatgtggaatgtgtattatttgtgagcacgatgcggcttcttcctcattttgcagagcaacctaagcgggcagatgtacaaaccgtgtgttcgaaacccctgagtccatgtgtgtgaaaatgcaggttttctcttagaaataaagtggtgacttgtgctgtaaaaaaaaaaaaaaaaaaa

SEQ ID NO: 344 - DNA, 1444 bp, Homo sapiens
cggacgcgtgggatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtctccggctcccgctcctcccctccagccccgcccttgccccctggctctggcagccctgggaccccccaagccctgccccgacgtctggttggcagcagcctccgagcccccacagtgccacccccgttaccccccacaccccctcagcctgcccggcgccaaagccggcgttcaccagcctcccccagcccggcctccccaggtccagcctcccccagcccagtctctttgagtaaccctgcacaggtggacctgggggctgccacagcagagggaggagcccctgaggctatcagtggggtccccactcccccagctatcccccctcagccccgccccaggagccttgcctcagagaccaactgagtggctggtttctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggacaaaaaaaaaaaaaaaaaaaaaaaaaaaaaaaaaaaaaaaaaaaaaaaaaaaaa

SEQ ID NO: 345 - DNA, 2832 bp, Homo sapiens
gtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttttaaaaaaaagaaaaaaaaagaagaaaagtataccagataccaaaagccagctttcttatgttttcctttaaattttcagatttaccttcattctgttttcactgatgtcttttgcaagcctttgattttttttttttttgttacagtttagtaatttatattcaccagtcacttcatatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctgtataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgttaaaaaaaaaaaaaaaaaaaaaaaaaaaaaaaaaaaaaaaaaaaaaaaaaaaaaaaaaaaaaaaaaaaaaacaaaaaaaaaaaaaaaaa

SEQ ID NO: 346 - DNA, 2352 bp, Homo sapiens
ccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggaaaaaaaaaaaaaaaa

SEQ ID NO: 347 - DNA, 3370 bp, Homo sapiens
gtacagcatcacttgccccatcattgtgccttttgggttgctctacctgtgcatgaagcacttgacggatcgctataacatgtactactcctttgcacccaccaaactgaacgagcagatccacatggctgccgtctcccaggccatctttgcgccactcttgggtctgttctggatgctgttcttctccatcctgcggttgggttctctccacgccatcaccatcttttccctgtccaccctcctcattgccatggtgattgcctttgttggcatttttctggggaagcttcggatggttgccgactacgagcccgaggaggaggagatccagacagtgtttgacatggagccaagcagcacctcctccacgcccacctccctcctgtatgtggccaccgtgctgcaagaaccggagttgaatctgacccccgcctcctccccagccaggcacacctatggcaccatgaacaaccagccggaagagggagaagaagagagtggtctgaggggctttgcgagggagctagactcggcccagttccaggaagggctggaactggagggccagaaccagtaccactgaccgggacctgaggcctccactggcgacttgttgaggggtcaggggagggcctggcaaggggaggcaggagggtggcctggacctccccactacctcctgcagactttgagaagcccacagtggagacatccaccaccccagccatgggccatacgggggtcctgacctgctgcccggctggaactgggggtgctcggcagtgctgaaggagcctgggaagggatgggaggatacaggcaagcacatgtcttgagagaggtggctggagccccggcacagagactgaacgctggggtcccttcctgggaccaagatggagaaggtgttcctaagggaggagacagaaggaggctgccgaaggctctgtggggtcatcaccactctgcatcagctgcccttccaaggagcttctgctgctgctcctcctcccagccccggcccattcctcccctgcagtctgaggaggcaaaggtatgtgcacggggcacattgacaggacacggaggaccacctcatcacagggttccctgcatggggatctgtaaagagaaagtttctgcacccaccagagcaagagccaactgaaagcgtagacctgagaagaggtaactcagccccttcctgctcctctgccctcatcagatgtccccaggagcagcagggcagaggcccttctttctattcttacaagggtagctagagcgtgatcactcagggctcatcaaatgagactcgtgtgcatttttcagaaggaaaccttggttagtccttgctgggtaacacaaagtggggtgagacgacagaagccgaattcatggaaggggggtcttctccccaaaaactctgtgtggtgggaaaccagctatacctccccaagccccagggcctaaagagaagaccccctaagccaaagatgtggccacttaaaagcgtctcctgcctcctacccaactgagtgcctgggcccccagcttggccaagatgggcagtacgttagggtaagaaccccatgcttcaaacttaaggactgaccatcacctgcgtcccaagtaggacccttcctcccttctcggggctgcccctgcaccctgccttgaagaccacccaagcggcctccagtgtgggcctggtccagacattgcagatgcttcaaccgtgatgtcgccccaggcctgccaggggtgtggtggaggggaaggccacgtgctccagggagaagccctttctggagaagcaaggctgtcctcccagggctgccactaccagagacctgggggagctgaattccgaacagtgatggtgacactcagcacctttgccacagccggggggaaccggcttctgcctctgggatgggctctcatcaggaccaccgtgcagcccagccagggaggacatgagaagggccagtgggggcctcaatgaaccagaacaagccaagctgaatggggtctgtgtgctccagggccctcttcagccccctcccccaaaggtctgggtccctgccaccaacctactgaaggccggcccccggctcacctcacctgagcacctgcaccaggccccaggcacatggctgccctgaactcagatcacctagaccttgtccctgccccacctttgccccatcctagccccagaagctccaagcttcaccgcaggtgagaaattgtgctcaatgggcagaaactgctatacccccagggcatggcccacattttggcatgagggtgtctttccagagagcttgggttggctggagagaggctgtctttcccattccttgtccagctaggaataaaggggaaatggtcctagcctggcccctacacacccaggtcccacaggccccctccccactggaatttcaccaaccaacaaggggaaagtacgctgttacagcatagcggtcaggcccagcaggagcttggcacatgatggggaggtggccagctccaggccctgcccgaccccatcatgtgtatttggtgtatggggtgtggggggtcacaccagaagctggcctggggtctcttctttgctggacacagctccctggcccctgcccccagcccctgcagcccctgccggactgtggaagccacatatgggaaaagtcctggcagacaatgtggcgggatgactgggggcttctccctctgaacctgggtccagtgtagcctggctctgagagaaggtggtgagcatgtggagaaggttccatagtccactcttaggggaaccagcaaagcctcatggcagttggctccatctggacctcccatggtcactacaggatggtggagcagggggcatcttttagcctccccccgccaccacatccaggccctctcaggcacctcctgcctcagcccacacctgcctcacccattgcccccctccccccacctactgccatcccactcctctgccagccacttcccagccgccccaccccactccatccaccaaatcacctcctgacttaatcctttctggaaggagctgccgcccaggaaccggtattgcctagagcctccaggaggggccctcctcaggcctccagtggccccatgcccacctgcctgaccctccactgcccctggaagcaaagtgcctatcagcagcgttgcgtcctctggggcccccggtcgggggggagggggtgtgggctaaccttggccaccaccacaaaaggaatgtgccagaatgctgaaccttcttgttaatgctatgaccgtgccttgaataaacaagtcctcccaaaaaaaaaaaaaaaaaaaa

SEQ ID NO: 348 - DNA, 2039 bp, Homo sapiens
cggacgcgtggggggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggaattcagagggacccagtgcatccaattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaatgttctttaataaataatcacacctaagtaataaaaaaaaaaaaaaaaa

SEQ ID NO: 349 - DNA, 1500 bp, Homo sapiens
ggcgcgcaggacgaagctcgcggcgcgggacccggaggacggtatcccgagcccaccgtgctacgcagctattccaatcaagttctctgaaaagcaacaggcttctcactacctctatgtgagagcacacggcattcaacaaggcaccaagtccacctggcctcagaagaggactctttttgtcttcaatgtgcccccatactgcacagagcaggagagcctgtcctgcctccagtccacctgtggccttgtccagtctgtagagttgaaggagaagctggagctggctgggagtcaaggtcgaagttttttcatccaaagccagttccgggtttccaggtagcctacgtggtgttccagaagccaagtggggtgtcagcggccttggccctgaagggccccctgctggtgtccacagagagccaccctgtgaagagtggcattcacaaatggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccaaaaagagctgctcaactacgcctggcagcatcgagagagcaagatggagcatctagcgcagctgcgcaagaagtttgaggaggacaagcagaggatcgagctgctgcgggcccagcgcaaattccgaccctactgagccgtgagagccgcagtggatggctggaggtgcagggccaggaggaacatgaggtgaggcagggcctgcagcggtctctgagaggccgagctctggccaacgggccccaggttgaaggccatcgcgtccaacagccccatcagagtccacacaggccaggagtgaaggaccaggccacccctcgggtcttgtgcttcagcagtcctggagacccaggcgtgcctagaggaggacttgtccttcccacctcttgcctccacacccttgaggaccctggatgaatccgttctgtgcttccttttccctcaatgcaaaagcccttgctggcaacaaaaaagcctcaaaagcagtgagaatacaagaaccttttattttccatccagttgggcagcagggaaaggctaggtgggcccagcctgcccttccttcctccagctggctggatatttattattagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcc

SEQ ID NO: 350 - DNA, 914 bp, Homo sapiens
cgcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcacca

SEQ ID NO: 351 - DNA, 4926 bp, Homo sapiens
cggagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcatgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggctaaagcccctggggtaacagtccccaccgctacccgaggtaaaacaataaaagctatgtggttgagctcaggcctctcgtgcctggtgtcagagaaggcagagcccacagtaggtgcagggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggagagcctgtatggccctgtagccctgggcagagctgggcctgtcgtgtgttcctgcctggcaggtgcaggtgctggccatctgcaggtggaaggaggtgggaatcttggattttttgtttttttttgtcttttttttttgagatgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcgtgagccagtgcacccggcggaatcttggaatttttatagacggcacctcagtttctgactccagccgcacacctcctgcctctaccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcagataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcactttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgccgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggtaaaaaaaaaaaaaaaaaaa

SEQ ID NO: 352 - DNA, 3333 bp, Homo sapiens
gtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacgtgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggaaaaaaaaaaaaaaaaaaaaa

SEQ ID NO: 353 - DNA, 1715 bp, Homo sapiens
aggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaaaaaaaaaaaaaaaa

SEQ ID NO: 354 - DNA, 1841 bp, Homo sapiens
ccacgcgtccgcccacgcgtccgaatgattcatgggggcctgatttgcatttgaaaaatgtttgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaagttaagtgttaataatttttgtgaatttatacacacctaaacgttaagtacacaaatattttatttgttttacaaataaggaataagtaatttataaattaagaagttacctataaaaataaaaagataacaaccctatcatatagcttatttttaaattacctgaaaaacgatattctacactgtttcctttttgactctgagttttcaaactgttacttctcccatatttctcaatccatttcactcagttgcacagtcttttaaaccctgtaattgtcataccaaagtttctttttaaaaaaaaattactttaaatgcttagtttattcaaagagcgatccaataatataaaaggaacatgtgttaaacacaataaaattttaaatggctctaaatcaagcacatcaagagtatacaagtcttaaaggctttttaatacatactcttttcccatctatgtaacccaacttgcacatttcagctgcatgtggtgaatatgcatcatatatttactttaagaggtaagattttacttgcaaaatacatgtgcaaattaggatccatcagttgatggaagagatggactctagaatattatttcttgtggttattactcctttacaaagcactttcgtctcacttgatcctcataaggaaactaaggctcagaatgagtagagctgggttcagaatctagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagttcattatgtagtggaggcttcgtggttgtccattgaattgtcacagcaaaatctataagtttcttcaattctacaagatagatccatatacctttgatcacttggagactctttttttgctggtttctagataactcaggtaaatcagacctttacagagtacagggctaggtgaaagaattactgaaaaatcaccttgaaaatccgaagggctgatataccctttatgttcctgactgatgcgcagaacctgggggaaatctacagcaatatacaggttgcaatgctgataacacaacagcaatcctctcctctacgtggacttactgttgtttttttaattattattggaatgggattttagaaaatagaagttacctttgtgtgtgttttagggaaggtagagaagaatctgctctttctctgaatactgttttgaccccaggcaggaccttggaaaggccaaaacattaacagtagtacttctgttcactgaagagttatgttacatgaagataaaatggttttgtcgtgtttattattgtattttgtgttgatataaataaacatggtaatttaaacaatgaaaaaaaaaaaaaaaaaaaaa

SEQ ID NO: 355 - DNA, 4187 bp, Homo sapiens
ggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggccagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaagcctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctgg

SEQ ID NO: 356 - DNA, 1779 bp, Homo sapiens
gtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgccaggagggcttggtgcaagagcttcagaaaaaacaggtggaattgcaggaagaacggaggggactgatgtcccaactagaggagaaggagaggaggctgcaacatcagaagcagccctgtcaagcagccaagcagaagtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtgtgtgtcctatgtctatgtatcgggtgaggggtgggagggttgctggagggtgctttattgggtggagggcaccatgtcccagggctatcaaataaagaatagtttggttttttttttaaataaaggttttattaccatttgcccaagaaggcagatactttcatatctgt

SEQ ID NO: 357 - DNA, 2591 bp, Homo sapiens
cccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaa

SEQ ID NO: 358 - DNA, 9517 bp, Homo sapiens
gttgctgtcggagagagaaagccgcacccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctccgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcaccgtgctgagtcacgggctgcggagcgggggtggagtaggagatgtactcaggaaaccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatcgatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaatgaaatcttttatatctgttgcctagttttgtacatggatctcattttacaagagaatctctctgcta

SEQ ID NO: 359 - DNA, 3500 bp, Homo sapiens
cacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggctgcaccaggagtacgtgccttccgcgcacctcagtggtacctgcacctgtctggcctgggcgccagcgcggctgcaggccaaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggggacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaagaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcagagaagacaaagggagcaacttcccctggacagaaggcaaagttggtgtatgaagaagagtcttctgaagaggagtctgatgatgaaatagcagataaggattctgaagataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgacttagatcctgaaaatgaaagtgaagaagaatgaagacagcaaagcaagccggtcaaactatataaactctggctcaccttgcccagtggtgagggctgcctctgtgccaggatgccaaggaccgctgcacatttccaaattcacagcagtggatcccatgccactttgctgtcctgagcaccccagacttgactgtgtaaataagagtgtttcattcaaatgttaataaactttacacagtatatagacacattttctgcaatgtactgacatcagtgtccaatatatggtatatttttataatataatatcctagtatgattggttatatcaagaattgacaagtgcagataaagacctttcccataggagttcaagaactggactgttgtgaagaagtcagctcttatctcaggttggtatctttcatcaaatccagatgcaaagcagcactagtgaaaatttttttaatttagtacatttaatttggtacattttcataaaatatgaagggataactacaaactggagtaaaaatgatggtaattaaaaaaaatcctcagtatccctagcttgtctattaactgtgataatctgacttgagtcagattgaatatttggagtgcttccccagaataaccacttatttttgaagctatcatgtgaagtatttttttaaaacaaaacaaaaattatggtcattaaaaaactagagaattagccatattaaggatttttcttgactgcaaattacttctaaagaatcatcagtgtatagattagaagtgctcattacctgcaacttttaaaaaaaattcagttatagctgcttttgaagaggtttccatttttatttaaattactaatggatcaaagaacaattgtttattttttctctttggttttagatattaatgataaccttgttggaattttttttccaaagaaaatatttttataattaaataatttaatgtttttcttccttttcattacctactcttggcagtgttagggtatctgtttacctttaaaatgataagtctcactcaagattttttatctatgtataaatattttggtgtgctacaaaagcctttacaaattatcagtagtagtttttttttttttttttttttttaaagaatgagccgatattggcttagtgctcactaggggacatgcacatggaagctcacctctaagaaagggctgggcagatggatttattttttcccacctgtgaatatgtaaaacaaaaccattatctttgagggagtttttaataccaatgacagaacagagatttgtgtgctcatcttaagagccagagccatataagcatcttgggaaagcaagtttgaaccagctgctggtgtaatgtacagttatatttgtctataaatggagctgtttatggcaatttaataccattctctttgtaaagtgaataaatattcatcttttccc

SEQ ID NO: 360 - DNA, 4573 bp, Homo sapiens
cgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccacaatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagcagaaattagaaaagaaaattaacttatgtggactgtaaatgttttatttgtaagattctataaataaagctatattctgt

SEQ ID NO: 361 - DNA, 6106 bp, Homo sapiens
cgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaagaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgtctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaat

SEQ ID NO: 362 - DNA, 2726 bp, Homo sapiens
caggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatag

SEQ ID NO: 363 - DNA, 2918 bp, Homo sapiens
gggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggaggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagtt

SEQ ID NO: 364 - DNA, 4043 bp, Homo sapiens
cgaagcgggtcctgccccgctgtcagctgcggcccccggcgccgggcgggggtggccgcgaccattggcggagaggcgaaaggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggggttcagctgttgcaaaaataattggtaataacgtcaagaaacttcagaaatttgcctccacagtcaagatgtgggtctttgaagaaacagtgaatggcagaaaactgacagacatcataaataatgaccatgaaaatgtaaaatatcttcctggacacaagctgccagaaaatgtggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaaactcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattacggtggttgatgatgcagacactgttgaactctgtggtgcgcttaagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaagaccattgaagagttggagaaggagatgctgaatgggcaaaagctccaaggaccgcagacttctgctgaagtgtaccgcatcctcaaacagaagggactactggacaagtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgcctttgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgtaaatgccatgtgcagcctttcctgaggccataggagggcttcctgcagctgagatctatgcaggccatcctctcaacaggtgccactccaagggcggtcctcggtgcagcagcatcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttgggg

SEQ ID NO: 365 - DNA, 1938 bp, Homo sapiens
attccggttgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattg

SEQ ID NO: 366 - DNA, 2573 bp, Homo sapiens
gaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacggcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcggacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatggagtgggacagttcctgagaccagccaacctgggggctttagggacctgctgtttcctagcgcagccatgtgattaccctctgggtctcagtgtcctcatctgtaaaatggagacgccaccacccttgccatggaggttaagcactttaacacagtgtctggcacttgggacaaaaacaaacaaacaaacaaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaaacccggcctgattaaagttaaataaatacg

SEQ ID NO: 367 - DNA, 2108 bp, Homo sapiens
gattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccacagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctg

SEQ ID NO: 368 - DNA, 2427 bp, Homo sapiens
gacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcagcaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 369 - DNA, 4994 bp, Homo sapiens
ccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagtcaggaagaacttctacaggaagagctcgccaacaccattgcacagctagtccatgctgttaacaactcagcggctcaacacctgttcattcagaccttttggcaaaccatgaatcgagaatggaaaggaatagacaggctacgcctggacaaatactatatgctgattcgtctggtcctgaggcagtcctttgaagtcttgaagcgaaatggctgggaagaaagccgaatcaaggttttcttggatgtcctgatgaaggaggtcctgtgtcctgagagtcagtctcctaatggagtgagattccacttcattgatatttacctggatgaactctccaaagtcggggggaaggagcttttagcagatcagaatctcaagtttatcgatccattctgcaaaattgctgcaaagacgaaggaccacaccctggtacagaccatagctcggggtgtcttcgaagctatcgtagatcagtctccttttgtgcctgaagagacgatggaggaacagaagacaaaagtgggtgatggtgacctctctgctgaggagatacctgaaaatgaggtatccttgagaagagctgtcagtaaaaagaagacagcactgggcaaaaaccattccagaaaagatggactcagtgatgaaagaggaagagatgactgtggaacctttgaggacacagggccccttctccagtttgactataaggctgttgctgatcgactcctggaaatgaccagcaggaagaacacgccccacttcaacaggaagcgcctctccaaactcatcaagaaattccaagacctttctgaaggaagcagtatatctcaactcagttttgcggaggacatttctgctgatgaagatgaccaaatcctcagtcaaggaaagcataagaagaaaggaaataaacttttagagaaaactaacttggaaaaggagaaaggaagcagagtcttttgtgtagaggaagaggacagtgaaagcagtcttcaaaagagaagaaggaagaagaagaagaagcaccacctgcagcctgaaaatccaggcccagggggtgcagccccgtccctggaacagaaccggggcagggagcccgaggcctctgggccgaaagccctgaaggcacgtgtggccgagccaggtgcagaggccacgtccagcactggggaggagagtggctccgagcatcctccagccgtccccatgcacaataaaaggaaacggccacggaagaagagcccgagggcccacagggaaatgttggaatcagcagtgttgcccccagaggacatgtctcagagtggcccgagtggcagtcatcctcagggacctagagggtccccgacaggtggagcccaactcctaaaaaggaagcggaaacttggagttgtgcccgtcaatggcagtggcctgtccacgccggcctggcctccattgcagcaggaaggccctcccacaggccccgcagagggggcgaacagccacaccacgctgccccagcgcaggaggctgcagaaaaagaaggcagggcccggcagcctggagctctgtggcctgcccagccagaaaacagcaagtttgaaaaagaggaagaaaatgagagtgatgtcaaacttggtggagcacaacggggtgctggagtccgaagctgggcaaccccaggctctgggaagcagtgggacttgcagttccctgaagaagcagaagctgagggcagagagcgactttgtgaagtttgacacccccttcttaccaaagcccctgttcttcagaagagccaagagcagcactgccacccaccctccaggccctgccgtccagctaaacaagacaccatccagctccaagaaagtcacctttgggctgaacagaaacatgactgccgaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaagaatgtggggccttttttatgattttgtaagttcccataagttgtgtgcacgaggttctgagagtgcccgcaggctgctgcgtcctggcccctctgtagtggctgcgggcgtcttggttgaatcttttgctacaaaccatgtttgcgtttgagctctccaggattttacatttttgggtaacctcagtgattcccattggtgtaggaaatgagaccctctctgaagctgaggagagcacgttgatctgaactttaaatcaatcagtgctgctggcacaatgaaaggtggaactgcacttgtgttgagctctcagttctgcggaatttggtactcattaccgtattcgccgtactaagttggtttctgttagtcttaacagtctgttttcttttaaaagcatgtagggcttcattgccatgttctgtgggtgtttggcaggttaccgatggggaagattcttgtcacagaatcagcaataccatagtttttctacatgtgctcagctgggggtgtggacaggtaggggtggggaaagaagaggctctgcgttctgggggctttttcttctcctccccctacccggtttccctccctgttttcctacctctacggcaagcccaaagtgtcttcccgggagcccagcgcagcccccggctcttacccaggaccccgccccgtgctgagccttctgctgaggtccttgcgtggagcacactcattcctccaagcccttgcgctcccgtttctctctctctccgtccacgttccagccgagtcactgcctgcctgaccggctccatggcagctccccatcttccctagaggctgcctgcgcatctggagcctgcgctccggctcagcgacctttcctctcaaatgcggaagcgtgcacttacagttcagaccgttctcctgtaagttcattacaaacacgggcggaaggcactcaggctttcgttggagaaacagaaataaggccttcttttgagcagcgattgctggatcattgatctgtttgaggaagtgtctgacctgggcctgagagctggagaaggtgcagattcaaagtgagcggctcctgaggagagccgccaaggctgctcgccttctccgtggcttccgcagctaccgtctgcacggtgagagggcacgggcacacggttcgggctggcgtgcagctctcccagccagccacgctctgctcaggcctggaagtgaaagccgcctccttcccgttatgccccccatacaggagcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggctgcgtggtttaatggctgcattagataggatcctcacatcccattcagaaccaaaactgatacagtgaaacaattaaggtgagcaaatagttttaacttttcttttttttttaagtttcattcttcctagaatatttttctaacaatttttatttcagctttaaagatgggtcatatagccaaacgggccatataatccaacattgttgagatgtcttaggacatctaaggcaaaactggcacatttgttctgcagactattgcaggaatgttttttcctagcatttctatattatctgtccattctgaggaaccagtgaatgtcctataaatgcacctcctgtcaaaaccatgcctgagaggtcccggctgggagtgacagggtgcttcttagattctattggtccttctctcattctccgaacttactcctttttatgggtaagtcaactaggtttacagtcccttatttttaatgcctaagttttgacagcaggaagaaaacaattttttaaaaattctcattacatagacgcacaagaatatgtcacataaagaaaatgtgtttagaatactggttttctatttacgcatgatattttcctaagtaaaattgccaagtggacttggaagtccagaaaggaaaataatttaaattaatgctggtgatcttaacaatattttgtaaaatgatgcttcccccttctccatggtctagtcaattttgtacaattaggtatctgactttacaagtttgttatcctttctaatttttactgaactgaaagcacaaagaagactacacagaaaatctggaaacagttgcaggtgttgggaggaagatgaaatcgagctgtcttttaacttttgtatgtgttttatcagaatttgctggactatgctggcaaggactttgtttacgatcaaattgtactagtgtctgcagggtttgtcagtactcgtcaaagccaagtccaattaaaaaaaaaaagtctttgccctcc

SEQ ID NO: 370 - DNA, 5307 bp, Homo sapiens
ccacgcgcggcgccgctcggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcatcgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 371 - DNA, 639 bp, Homo sapiens
cgcgggaacgctaacctggtccggagcgagtctgggtctcagccccgcgaacagcctttcacgagtcttcaagctttcaggctatcttctagtcaagatgagtgataagccagacttgtcggaagtggagaagtttgacaggtcaaaactgaagaaaactaatactgaagaaaaaaatactcttccctcaaaggaaactatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcttctcacctatgttccctggctaagaagtcagaggtagccaatgtttccttaaattcatttttaaacttaccattggtgcatatgttccagatggcagatgctgtcaataatctcaccattgatgacctttgtgtatgtagttcttgcatcctatactggataagcctgttttaacctgctatgatgggtgcttccattgcttcataatcttcatgaagttgcatgcttttgcagcttttcacagtttatttgcatttctaatgtagtaataaagtaaccaatataatcatt

SEQ ID NO: 372 - DNA, 4814 bp, Homo sapiens
ggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaagtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagtcacaacatcgcactgtcccaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatctttt

SEQ ID NO: 373 - DNA, 6050 bp, Homo sapiens
ggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaagagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctgctggagtcaatcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcactgtgaacctgctgaatttctacaaagataacaacagggaggagatgtacataaggtacctgtacaaactccgcgatcttcacctggactgtgacaattacacagaggctgcctacacgctccttctccacacctggcttctcaagtggtcggatgagcagtgtgcatcacaggtcatgcagacaggccagcagcacccccagacacaccggcagctcaaggagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtatatccagtgcttcactgtccagcctgtcttggatgaacatcccaggttcaagaataagccagtgcctgaccagattataaacttctacaaatccaactacgtgcaaaggttccactactcccggcccgtgcgcagggggaccgtagacccagagaatgagtttgcttccatgtggattgagagaacctccttcgtgactgcatacaagctgccggggatcctgcgctggtttgaggtggtgcacatgtcgcagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgccccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcggctttccaggaagcatgagttcatgagtgacaccaacctctcggagcatgcggccatccccctcaaggcgtctgtcctctctcaaatgagctttgccagccagtccatgcctaccatcccagccctggcgctctcagtggcaggcatccctgggttggatgaggccaacacatctccccgcctcagccagaccttcctccaactctcagatggtgacaagaagacactcacacggaagaaggtcaatcagttcttcaagacaatgctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagctggagtgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgcttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcg

SEQ ID NO: 374 - DNA, 6237 bp, Homo sapiens
ctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggccctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggactgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaac

SEQ ID NO: 375 - DNA, 6239 bp, Homo sapiens
cgatctgcttctgatgaaagctctggtatcgagactttagtggaggagctctgctccagactgaaagaccttcagagtaagcaagaagagaagattcacaaaaagttagaggggtctccctctccagaggcagaattatcccctccagcaaaggatcaagtggaaatgtactatgaagcatttccaccactttctgagaaaccagtttgcctgcaagaaatcatgactgtgtggaacaagtctaaagtctgttcttactctagctcttcttcatcatccacagccccaccagctagcacagatacttcctctcctaaggactgcaacagtgaaagtgaagtcaccaaggaaagaagcagtgaagtacccaccactgtgcatgagaaaacccagagcaaaagcaaaaacgagaaggaaaacaaatttagtaatggcacaattgaagaaaagcctgctttgtacaaaaagcaaatccgacataaacctgaaggaaagattcgccctcgctcgtggtcttctggctccagtgaagcaggctcaagttccagtgggaatcagggagaattaaaagcatccatgaagtatgttaaagtaagacacaaggcacgagagattcgaaacaaaaaagggcggaatgggcaaagcaggctttctttgaagcacggtgaaaaggctgaaaggaacattcatactggaagtagtagcagtagcagcagtggttctgtcaaacagctgtgcaagcggggtaagagacctttaaaagaaatagggagaaaagatcctgggagcactgaaggaaaagacctgtacatggagaatagaaaggacacagagtataaagaggagcccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaatatgattcgacagaaaagcaaagagaacacagattttgaggcagaatgttgcatagtgttagatggtatggagttgcaaggggaacgtgcaatatggacagattctaccagctccgtaggtgctgagggcttattcctgcaggaccttggcaatctggctcagttttgggagtgctgttcatccagctccggtgatgctgatggggagagttttggaggagactctccagttagactctctcccatcttagacagcacagtgctcaattcacacctgcttgctggcaatcaagagctcttttcagatattaatgaaggatctggtataaactcttgtttttcagtgtttgaagtgcaatgcagtaattctgttttaccattttcttttgaaacactcaacttgggaaatgaaaatacagattctagtgctaatatgcttgggaaaacacagtctagattgctaatatggaccaaaaatagtgcctttgaagaaaatgaacactgttctaatctttcaacaagaacttgtagtccatggtcccattcagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagctagaacaaaaaacagaaaacaaaaattttgaaactacacaagtatgtaatgaaagtccacatggagatggctacagctcaggggttattaaagacatttggacaaagatggcagacacaaattctgtggctacagtagaaatagaaagaactgatgctgagttgttttcggcagatgtaaataactactgctgctgtctagatgctgaagctgaactggagacccttcaggagcctgataaggctgtgcggaggtcagagtaccatctgtgggagggacagaaagagagcctggagaaaagagcatttgcttctagtgagctatcaaacgtggatggtggtgattatacaacaccctctaaaccctgggatgtagcccaagataaagaaaacacattcattcttggaggagtttatggagaactcaaaaccttcaatagtgatggggagtgggcagtcgtaccacctagtcacacaaaaggaagtctgttacagtgtgcagcttctgatgttgtgacgatagctggtacagatgtctttatgaccccaggaaacagttttgctcctgggcacaggcagttatggaaacccttcgtgtcatttgaacagaatgatcagccgaagagtggggaaaatgggttaaataagggattttcttttatcttccatgaagacttactaggagcttgtggcaactttcaagtcgaagatcctggacttgaatactcattttcttcctttgacttaagcaatccattttcacaagttcttcatgtagaatgctcatttgaacctgaagggattgcatctttcagccccagttttaaaccgaaatcaatcctctgttctgattcagacagtgaagtgtttcaccccaggatatgtggtgttgacagaacacaatacagggctattcggatctctcctcggactcactttcgcccaatttctgcatccgaactgtccccaggaggaggaagcgagtcagaatttgaatctgagaaagatgaagcaaatattcccattccttctcaagttgatatatttgaagatccgcaggcagatctcaaacctttggaagaagatgcagagaaagaaggccattactatggaaaatcagagcttgagtctggaaaattccttcccaggttaaaaaaatctgggatggaaaagagtgctcagacatcactggattcccaggaggaatcaactgggattctttcagtaggaaagcaaaatcagtgtttggaatgtagcatgaatgaatccctggaaatagatttagaaagctcagaagcaaattgtaaaataatggcacaatgcgaggaagaaattaataatttttgtggttgcaaagcaggttgtcagtttcctgcttatgaagataatccagtttcttcgggacagctggaagagttccctgtattgaacactgatatacaaggaatgaatagaagtcaagaaaaacagacctggtgggaaaaagccttgtactctcctctttttcctgcatcagagtgtgaagaatgttacacaaatgccaagggagagagtggtttagaagaatatccagatgctaaagagacacccagtaatgaagagcgcctgttagattttaatagggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaatagtacaaattattgtttaaaaatgatatgtgatggaaaattactcttcagtgagacctgttaatctaaaacaacaacttaggtttcctcttcaattaactgattcagattggtaataattatctttctcttcttgcttattttagagttgaggacagctatcctgttaaagattttttttcccagctgttaaattcttggctatttgaaatagactagattgtgttgtcaaatcaagaatgggtgtgcatgtgcttgtcttagaagtatcactgctttttgcatcttaactgcagttaattttccttccgactgcggttatatcactatgaccttactagcattgcagtgtcaacaaccacttctgctcttcagagacttcagctttggagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttgcagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacatcttttgacactttaaggtgggtgggtgtgtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaac

SEQ ID NO: 376 - DNA, 5630 bp, Homo sapiens
caagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatcccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 377 - DNA, 2635 bp, Homo sapiens
ccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctggatgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcacgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatgtt

SEQ ID NO: 378 - DNA, 8924 bp, Homo sapiens
gagagcgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactacgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtcttccagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcctggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccagagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggcggcccccctccccgcccaccgccccggcagagcctccaggagcagctgaacggggtcatgcccatcgccatgagcatcaaggcaggcacggtggatgaggactcgtcaggctccgaatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgtctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgcgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctccccctgtcttctcccctcagcaattcctgcaaagggttaaaaatttaactggtttttactactgatgacttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggt

SEQ ID NO: 379 - DNA, 6371 bp, Homo sapiens
caggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagttctgttcagaatagtgaacgtggcaaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttttgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttgggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggacatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatactgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcagactttctattaacatttctagctaagagtttgactcttagtggtcactttactgactttccaacataaaacaagtatctcagaagatacagctttcatcatagaaatggtcaaaagaccatagctatatttccttcaggttctgggaggtggagtttttcaaggaacactggccgttgtattgttggcaggggccccaaggcagctcgcacaatcaaaggcaggaagcctcacccctggtcctgtgaccccccccaccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaatgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcc

SEQ ID NO: 380 - DNA, 282 bp, Homo sapiens
aatatccctggtgaaattagaggcatagcttgagactggtgacagtgcaacacagaccttcaggagctgctttgaggactggcctgcccagatgcctgctgttaagccagcagccccctcactccggcccctgccatcttgacagatggagctgccatggtttcagggacactcagcagggcatctgggttggtccctcccacatggaccttgtaaagttgctattcaggggaacctgggtatcgtttcaggcaaaacacagaaccatattagcacttctaa

SEQ ID NO: 381 - DNA, 2106 bp, Homo sapiens
aattccggcagagctccgtttcctcatagaacaaagaacatccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtcccgcatcagcaaccactcaaatatccaggtgtctgagatggtgcacaaagctgtggtggaggtggacgagtcgggaaccagagcagcggcagccacggggacaatcttcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacgacaggtttagttgactagatgaggcattacaaataatattactctatggatgattgcttccacccacacgactgcaacatacaggtgccttggggaaatgtggagaacattcaatctgccgtcactattcatcaatgaagattagcactgagatccagagaggctggatggacttgctcaagttcaccagcatggtagtggcaaagagaggtccagagtcctggcccttgatgccgagctcatgccacaaagctcagtaggagggatgttccagtggatgagggccagccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtgtcagttgcaggtgccaatgactaactttttg

SEQ ID NO: 382 - DNA, 1977 bp, Homo sapiens
cactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagaacctcatctcaagccaggcctcgagctacttcattgacgctgccacagtcgacgacagtggagagtacaggtgccagacaaacctctccaccctcagtgacccggtgcagctagaagtccatgtcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacaaatgacccccatcccatgggagtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattgaagtttcagagctacacaaacactttttctgtcccaaccattccctcacagtaaaacaacaatacaggctagggatggtaatcctttaaacatacaaaaattgctcgtattataaattacccagtttagaggggaaaaaagaaaataattattcctaaacaaatggataagtagaattaatgattgaggcaggaccctacagagtgtgggaactgctggggatctagagaattcagtgggaccaatgaaagcatggctgagaaatagcagggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatttccaagtatataacgatgagccctctaatgctaggagtagcaaatggtcctaggaaggggactgaggattggggtgggggtggggtggaaaagaaagtacagaacaaaccctgtgtcactgtcccaagttaagctaagtgaacagaactatctcagcatcagaatgagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatgtctagttcctgtatagctttgttcattgcatttattaaacaaatgttgtataaccaatactaaatgtactactgagcttcactgagttacgctgtgaaactttcaaatccttcttcagtcagttccaatgaggtggggatggagaagacaattgttgcttatgaaaaaaagctttagctgtctcctgttttgtaagctttcagtgcaacatttcttggttccaataaagcattttac

SEQ ID NO: 383 - DNA, 2154 bp, Homo sapiens
gggggcagagggagcgagcgggcggccgcctagggtgcaagagccgggcgagcagagttgcgctgcgggcgtcctgggaagggagttccggagccaacagggggcttcgcctctggcccagcccttccggagccaacaggggacttcgcctctggcccagccctcccgctgatcccccagtcagcggtccgcaagccttgccgcatccacgaaactttgcccatactgcgggcgtacactttgcacttgaacttacaacacccgagcaaggacgcgactctcccgacgcggggagactattctgcccatttggggacacttccccgccgctgccaggacccggttctctggaaggctgtccttgaagctccttagacgctggagttttttcgggaagtgggaaagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaactttttatgcttaccatcttttttttttctttaacagatttgtatttaagaattgtttttaaaaaattttaagatttacacaatgtttctctgtaaatattgccattaaatgtaaataactttaataaaaacgtttatagcagttacacagaatttcaatcctagtatatagtacctagtattataggtactataaaccctaattttttttatttaagtacattttgctttttaaagttgattt

SEQ ID NO: 384 - DNA, 5406 bp, Homo sapiens
gaccagatcagcccccagagcagcctcatggctggaggatccaagagaggttagatccgtctgtctgtctgctaccttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagcccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgtcactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggcttcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 385 - DNA, 649 bp, Homo sapiens
ggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgattttatttggagagaagcaagcatctttgcctctttggagtaggaaattcagacttgaaaaagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttc

SEQ ID NO: 386 - DNA, 3202 bp, Homo sapiens
ctgagacaccgcagcttccctgagcgccgagtccctccggggacagcagcagggagcgcccgcgcagccaccgagcctctgcccagccaagccgccgtcgccgcgccgggggaccgccagccatggccgcgccgggggatccgcaggacgagctgctgccgctggccggccccgggtcccagtggctcaggcaccgaggggagggggagaacgaagcggtgacgccgaaaggggccacgccggcgccgcaggctggggagcccagcccggggttgggcgccagggcccgggaagcggcgtcgcgggaagccggctcgggccccgcccggcagtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaat

SEQ ID NO: 387 - DNA, 319 bp, Homo sapiens
ttctccggcaggtgggcattaactaccagccccccacggtggtccctgggggagacctggccaaggtgcagcgggctgtgtgcatgctgagcaacaccacggccatcgcggaggcctgggctcgcctggaccataagttcgatctcatgtatgccaagcgggcctttgtgcactggtacgtgggagaaggcatggaggagggggagttctctgaggcccgcgaggacctggcagctctggagaaggattatgaagaggtgggcgtggattccgtggaagccgaggctgaagaaggtgaagaatactgaggggagggtgt

SEQ ID NO: 388 - DNA, 4011 bp, Homo sapiens
gggtagagacggggtttcaccgtgttagccaggatggtctggatctcctgacctcgtgatccacccacctcggcctcctaaagtgctgggattacagacatgagccaccgcgcccagccctattcatcccttttcaaaagtcagaccctaggaagctggagggaggtggggcatggttttacagtgaatttctgatttcactcagggtgataaatcagactcttggggaagcgggtggtggctctggacagcagcaggaatggggatccagttagcaacaaatccatggacctatgacaggctgaaagccaccccttctccatctttgggaggttgccaatgtctgatttaacactatccaatgaatgatcattgaaagtaaaaaataactatcaactagcagaaaatataaatggtaagcattagcacatatttcacatgtttatatttggctctcagattgacctataaaacaaagtctgggaaattctatatgatcctgaaaaaatgatacgctggtctggatggtagaataagttggagaaatgtttaagccaaaatgcagtcttaccaatgactttttattttattttattaattttcaggatttttggtatacaggtggtttttggttacatggaaaagttctttactggtgatttctgagattttagttcaccccttatcctgagcagtgtacactgttcccaatatgtagccttttatccctcaccccctctaagttcaagaagactatggtcctgcagaaagctttatatgtaattaacatatctttatctttatctttataggcagtagactcatcttttgaaacagattccattaagagtgaatgtgtaccctccctctagcctttattattactgtttttgctattacatgtgttagtgtatgtgaatttaatgcttaaaaatgtatcccattggctactatggcaaaaggttgactcataagagtttagcacgggttaagatctgaaagttttctcccagcctcttatcactggcgcagacttcacaattcatggaagccaccagtgagatgacattgcctcaggcagttactatttttatattctataactcgaggagctcagggtttcggaaatcattaaactttttttgtccttttaaagttggagacagcaattgtagacagccttccagtgggttatctttttgtgtctccttacctgtggagaagcctattagctgggatatgtagttaaatagctatatttatatatatccagggcaccccgaattcgggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcggcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtac

SEQ ID NO: 389 - DNA, 1374 bp, Homo sapiens
attgcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccattttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcactgagtggacggattcaccaat

SEQ ID NO: 390 - DNA, 3672 bp, Homo sapiens
acatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcacgagcctctgtgggggaggataggctgaaaaaaaaaagtgggctcgtatttatctacaggactccatatagtcatatataggcatataaatctatgctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacattgagcccaacaggtccacgatggatccacctagtcccaccccagcctttttctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttcatggatttgagaggaaagagaggaaaatgggggaatgggttgcaaaatagaaatgagcttaatccaggccgcagagccagggaaggtgagtaaccttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatcaaggcagccacaaggccttgacctgccgagtcagcatgccccatctctctcgacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctcgctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggcccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctcgtcccgccacgcaccggttagtgagacagggctgccacgcaaccgccaagcccccctcaaggtgggacagtaccccggacccatccactcactcctgagaggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaa

SEQ ID NO: 391 - DNA, 1092 bp, Homo sapiens
gaattcggcacgagtggaaacgcagagcgccggggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttggaaatcaaggaatgtgaaatcaggacttgtaagaaccaaggatgttagtgctctgacaaaagcagtgatttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagctccgtcccttcttccattctcagccagaagcataaacagaaaagaaagatttagaggattcacactcaacaggttttaggatatttatatcaaaaattgattgttatcttacacattaggtataatttatcatttatctgaaatcacatgtagcagattgcatagtcttgtaatcctctcagagggaaacttcttgtctaaacagctctatatggatttatcctccatattcc

SEQ ID NO: 392 - DNA, 178 bp, Homo sapiens
ctgtggtggtaccttctggagaggagcagagatacacctgccatgtgcagcatgagggtctgcccaagcccctcaccctgagatgggatagaaaaggagggagctactctcaggctgcaagcagtgacagtgcccagggctctgatgtgtctctcacagcttgtaaagtgtgagacag

SEQ ID NO: 393 - DNA, 1023 bp, Homo sapiens
cggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgagtccaacctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaaagctttcccacttggctcttattcttccacaagagctttgtcaggaccaggttgttactggttcagcaactctgcagaaaatgtcctcccttgtggcttccttagctcctgttcttggcctgaagcctcacagctttgatggcagtgcctcatcttcaacttttgtgcttccctttacctaaactgtcctgcctcccgtgcatctgtactccccttgtgccaca

SEQ ID NO: 394 - DNA, 640 bp, Homo sapiens
cgcgcgcccgaacgaagccgcggcccgggcacagccatggcccggcgggcggggggcgctcggatgttcggcagcctcctgctcttcgccctgctcgctgccggcgtcgccccgctcagctgggatctcccggagccccgcagccgagccagcaagatccgagtgcactcgcgaggcaacctctgggccaccggtcacttcatgggcaagaagagtctggagccttccagcccatcccattggggacagctccccacacctcccctgagggaccagcgactgcagctgagtcatgatctgctcggaatcctcctgctaaagaaggctctgggcgtgagcctcagccgccccgcaccccaaatccagtacaggaggctgctggtacaaatactgcagaaatgacaccaataataggggcagacacaacagcgtggcttagattgtgcccacccagggaaggtgctgaatgggaccctgttgatggccccatctggatgtaaatcctgagctcaaatctctgttactccattactgtgatttctggctgggtcaccagaaatatcgctgatgcagacacagattatgttcctgctgtatttcctgcttccctgttgaattggtgaataaaaccttgctcttt

SEQ ID NO: 395 - DNA, 1612 bp, Homo sapiens
gaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggctgtataaaatggcagttggatttatgcttgctcatccttatggttttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaac

SEQ ID NO: 396 - DNA, 1639 bp, Homo sapiens
agcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgagccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaagaaacaattgggtacccagttaaattttcatttcagataaacaacaaataattttttagtataagtacattattgtttatctgaaagttttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 397 - DNA, 847 bp, Homo sapiens
ggccacatggactggggtgcaatgggacagctgctgccagcgagagggaccagggcaccactctctagggagcccacactgcaagtcaggccacaaggacctctgaccctgagggccgatgaggccagggacaggccaggggggccttgaggcccctggtgagccaggccccaacctcaggcagcgctggcccctgctgctgctgggtctggccgtggtaacccatggcctgctgcgcccaacagctgcatcgcagagcagggccctgggccctggagcccctggaggaagcagccggtccagcctgaggagccggtggggcaggttcctgctccagcgcggctcctggactggccccaggtgctggccccgggggtttcaatccaagcataactcagtgacgcatgtgtttggcagcgggacccagctcaccgttttaagtcagcccaaggccaccccctcggtcactctgttcccgccgtcctctgaggagctccaagccaacaaggctacgctggtgtgtctcatgaatgacttttatccgggaatcttgacggtgacctggaaggcagatggtacccccatcacccagggcgtggagatgaccacgccctccaaacagagcaacaacaagtacgcggccagcagctacctgagcctgacgcccgagcagtggaggtcccgcagaagctacagctgccaggtcatgcacgaagggagcaccgtggagaagacggtggcccctgcagaatgttcataggttcccagccccgaccccacccaaaggcctggagctgcaggatcccaggggaagggtctctctctgcatcccaagccatccagccct

SEQ ID NO: 398 - DNA, 2096 bp, Homo sapiens
gaattcctctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggcatcctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccactccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtgtgtgtgtgtatacatgccagtgacacttccagtcccctttgtattccttaaataaactcaatgagctcttccaatccaaaaatgttaaaattagccaggcatagttgtgtgtgcctacagtgctacaggaggctgaggcaagaggattgcttgagttaaggaaggaagtcaaggctgcagtgagctatggtcatgccactgcactccagcctgggcaacagcaagaccctgtgtccaaaaaaaaaaaaggaattc

SEQ ID NO: 399 - DNA, 2907 bp, Homo sapiens
ggaaccatggagctcagcgtcctcctcttccttgcactcctcacaggcctcttgctactcctggttcagcgtcaccctaactcccatggcaccctcccaccagggccccgccctctgccccttttggggaaccttctgcagatggacagaagaggcctactcaaatcctttctgaggttccgagagaaatatggggacgtcttcacggtacacctgggaccgaggcccgtggtcatgctgtgtggagtagaggccatacgggaggccctggtggacaacgctgaggccttctctggccggggaaaaatcgtcatcatggacccagtctaccagggatatggcatgctctttgccaatggaaaccgctggaaggtgcttcggcgattctctgtgaccaccatgagggacttcgggatgggaaagcggagtgtggaggagcggattcaggacgaggctcagtgtctgatagaggaacttcggaaatccaagggagccctcgtggaccccaccttcctcttccattccattaccgccaacatcatctgctccatcatctttggaaaacgcttccactaccaagatcaagagttcctgaagacgctgaacttgttctgccagagtttcttactcatcagctctatatccagccagctgtttgagctcttctctggcttcttgaaatactttcctggggcacacaggcaagtttacaaaaacctacaggaaatcaatgcttacattggccacagtgtggagaagcaccgtgaaaccctggaccccagcgcccccagggacctcatcgacacctacctgctccacatggaaaaagagaaatccaacccacacagtgaattcagccaccagaacctcatcatcaacacgctctcgctcttctttgctggcactgagaccaccagcaccactctccgctacggcttcctgctcatgctcaaataccctcatgtcgcagagagagtctacaaggagattgaacaggtggttggcccacatcgccctccagcgcttgatgaccgagccaaaatgccatacacagaggcagtcatccgtgagattcagagatttgctgaccttctccccatgggtgtgccccacattgtcacccaacacaccagcttctgagggtacaccatccccaaggacacggaagtatttctcatcctgagcactgctctccgtgacccacactactttgaaaaaccagacgccttcaatcctgaccactttctggatgccaatggggcactgaaaaagaatgaagcttttatccccttctccttagggaagcggatttgtcttggtgaaggcattgcccgtgcggaattgttcctcttcttcaccaccatcctccagaacttctccgtggccagccccgtggctcctgaagacatcgatctgacaccccaggagtgtggtgtgggcaaaatacccccaacataccagatctgcttcctgccccgctgaaggggctgagggaagggggtcaaaggattccagggtcattcagtgtccccacctctgtagataatggctctgactccctgcaacttcctgcctctgagagacctgctgcaagccagcttccttcccttccatggcaccagttgtctgaggtcgcagtgcaaatgagtggaggagtgagattattgaaaattataatatacaaaattatatatatatattttgagacagagtctcactcagttgcccaggctggagtgcagtggcgtgatctcggctcactgcaacctccacccccggggttcaagaaattctcctgcctcagcctccctagtagctgggattacaggtgtgtgctaccatgcctggctaatttttgtatttttagtagagatggggtttcaccgtgttggccaggctgatctcaaactcctgaactcaagtgattcacccaccttagcctcccaaagtgctgggattacaggtgtgagtcaccatgcccggccatgtatatatataattttaaaaattaagatgaaattcacataaaataaaattagccattttaaagtgtacaatttagtggtgtgtggttcattcacaaagctgtacaaccaccaccatctagttccaaacattttctttttttctgagacggagtctcactctgtcacccaggttcgagttcagtggtcttgaactcctgatgtcaggtgattctcctagttccaaatgttttcattatctctcccccaacaaaacccatacctatcaagctgtcactccccataccccattctctttttcatctcagcccctgtcaatctggtttttgtccttatggacttaccaattctgaatatttcctataaacagaatcacacaatatttgattttttttttaaaactaagccttgctctgtctcccaggctggagtgctgtggcgtgattttggttcactgcaacctccgccttccaagttcaagagattctcctgcctcagcttccaagtagctgggattacaggcatgtggtaccacgcctggctaattttcttgtatttttagtagggacatgttggccaggctggttgtgagctcctggcctcaggtgatccacacgcctcagtgtcccagagtgctgatattacaggcgtaatatgtgatcttttgtgtctggttcctttcacgttgaacgctatttttgaggttcgtgcctgttgtagaccacagtcacacactgctgtagtcttcccccatcctcattcccagctgcctcctcctactgtttccctctatcaaaaagcctccttggcgcaggttccctgagctgtgggattctgcactggtgctttggattccctgatatgttccttcaaatccactgagaattaaataaacatcgctaaagcctgacctccccacgtc

SEQ ID NO: 400 - DNA, 3045 bp, Homo sapiens
cagaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatcttggctcactgcaacctccacccccggggatcaagcaactctcctgcctcagcctccctagaggctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagccgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaacagaatcatacaatatttgatttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttcctaagtgctgatattacaggcataatatgtgatcttttgtgtctggttgctttcatgttgaatgctatttttgaggttcgtgcctgttgtagaccacagtcacacactgctgtagtcttcccgagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctcccc

SEQ ID NO: 401 - DNA, 2527 bp, Homo sapiens
tccgggcctggcctgtacggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactaccgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatgcgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatgaaaaaaaaaaaaaaaaaaaaaaaaaaggtttgtgttctcgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcctggagttgtgaacgccgcggactccggagccgcacaaaccagggctcgccatgaagccaggattcagtcccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggaggcttccattctggtggcaaccggggtcgtggtcggggaggaaaaagaggaaaccagtcggggaagaatgtgatggtggagccgcatcggactgagggtgtcttcatttgtcgaggaaaggagatgcactggtcaccaagaacctggtcctgggaatcaagttatggagagaagagagtctcgattcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagtttccccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggaatgtggccctgaaagcccacaccttcctgcgctaatggaggacactttgtgatttccattaaggccaactgcattgactccacagcctagcggtcaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcccgtgtgtttttctaattaaaagactcctccgtc

SEQ ID NO: 402 - DNA, 2961 bp, Homo sapiens
aagagatgatttctccatcctgaacgtgcagcgagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcggaatcgtaaccaggtgtccgctggtgctgaaactgaaaaagcagccctgtgaggcatgggccggaaggatcagctaccggaacaccgagctagagcttcaggaccctggccaggtggagaaagagatacacaaagcccagaacgtcatggccgggaatggccggggcatcagccatgagctcatcagcctggagatcacctcccctgaggttccagacctgaccatcattgaccttcccggcatcaccagggtggctgtggacaaccagccccgagacatcggactgcagatcaaggctctcatcaagaagtacatccagaggcagcagacgatcaacttggtggtggttccctgtaacgtggacattgccaccacggaggcgctgagcatggcccatgaggtggacccggaaggggacaggaccatcggtatcctgaccaaaccagatctaatggacaggggcactgagaaaagcgtcatgaatgtggtgcggaacctcacgtaccccctcaagaagggctacatgattgtgaagtgccggggccagcaggagatcacaaacaggctgagcttggcagaggcaaccaagaaagaaattacattctttcaaacacatccatatttcagagttctcctggaggaggggtcagccacggttccccgactggcagaaagacttaccactgaactcatcatgcatatccaaaaatcgctcccgttgttagaaggacaaataagggagagccaccagaaggcgaccgaggagctgcggcgttgcggggctgacatccccagccaggaggccgacaagatgttctttctaattgagaaaatcaagatgtttaatcaggacatcgaaaagttagtagaaggagaagaagttgtaagggagaatgagacccgtttatacaacaaaatcagagaggattttaaaaactgggtaggcatacttgcaactaatacccaaaaagttaaaaatattatccacgaagaagttgaaaaatatgaaaagcagtatcgaggcaaggagcttctgggatttgtcaactacaagacatttgagatcatcgtgcatcagtacatccagcagctggtggagcccgcccttagcatgctccagaaagccatggaaattatccagcaagctttcattaacgtggccaaaaaacattttggcgaatttttcaaccttaaccaaactgttcagagcacgattgaagacataaaagtgaaacacacagcaaaggcagaaaacatgatccaacttcagttcagaatggagcagatggttttttgtcaagatcagatttacagtgttgttctgaagaaagtccgagaagagatttttaaccctctggggacgccttcacagaatatgaagttgaactctcattttcccagtaatgagtcttcggtttcctcctttactgaaataggcatccacctgaatgcctacttcttggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaactcttctgtcactatcagtgtccatctctactgtactccctcagcatcagagcatgcatcaggggtccacacaggctcagctctctccaccacccagctcttccctgaccttcacgaagggatggctctccagtccttgggtcccgtagcacacagttacagtgtcctaagatactgctatcattcttcgctaatttgtatttgtattcccttccccctacaagattatgagaccccagagggggaaggtctgggtcaaattcttcttttgtatgtccagtctcctgcacagcacctgcagcattgtaactgcttaataaatgacatctcactgaacgaatgagtgctgtgtaagtgatggagatacctgaggctattgctcaagcccaggccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatgagcttccattgttctgttaagtcttgaagaggaatttaataaagcaaagaaactttttaaaaacgt

SEQ ID NO: 403 - DNA, 2372 bp, Homo sapiens
ttctgggatggctatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttgctttaacatctttttttttttttgacagagtctcaatctgttacccaggctggagtgcagtggtgctatcttggctcactgcaaacccgcctcccaggtttaagcgattctcatgcctcagcctcccagtagctgggattagaggcatgtgcatcatacccagctaatttttgtattttttattttttatttttagtagagacagggtttcgcaatgttggccaggcgatctcgaacttctggcctctagcgatctgccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattctatttgtctataatgatcatatattacctttgtaataaaacattataatc

SEQ ID NO: 404 - DNA, 1480 bp, Homo sapiens
accagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctc

SEQ ID NO: 405 - DNA, 1416 bp, Homo sapiens
  Modified_base 1311: n = a,c,g, or t
aggaattccggaattccggaattccgatggatggaacagaaaataaatctaagtttggtgcgaacgccattctgggggtgtcccttgccgtctgcaaagctggtgccgttgagaagggggtcccctgtaccgccacatcgcgtacttggctggcaacttcgaagtcatcctgccagtcccggcgttcaagtgtcatcatcaatggcggttctcatgctggcaacaagctggccatgcagagtctgtcctcccagtcggtgcagcaaactcagggaagccatgccgcattggagcagaggtttaccacaacctgaagaatgtcatcaaggagaaatatgggaaagatgccaccaatgtggggatttgcgcgggtttgctcccaacatcctggagaataaagaaggcctggagctgctgaagactgctattggaaagcctggcctacactgtaaaggtggtcatggcatggacgtagcggcctccgagttcttcaggtcagggaactatgacctggacttcaagtctcccgatgaccccagcaggtacatctcgcctgaccagctggctgacctgtacaagtccttcatcaaggactacccagtggtgtctatcgaagatccctttgaccaggatgactggggagcttcagaagttcacagccagtgcaggaatccaggtagtggggggatgactcacagtgaccaacccaaagaggatcgccaaggcgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactggggcagatcaagactggtgccccttgccgatcacgcgcttggccaagtacaaccagctcctcagaattgaagaggagctgggcagcaaggctaagtttgccggcaggaacttcagaaaccccttggccaagtaagctgtgggcaggcaagccttcggtcacctgttggctacagacccctcccctggtgtcagctcaggcagctcgaggcccccgaccaacacttgcaggggtccctgctagttagcgcccaccgccgtggagttcgtaccgcttccttagaactctacagaagccaagctccctggaagccctgttggcagctctagctttgcagttgtgtaattggcccaagtcattgtttttctcgccttactttccaccaagtgtctagagtcatgtgagcctngtgtcatctccggggtggccacaggctagatccccggtggttttgtgctcaaaataaaaagcctcagtgacccatgaaaaaaaaaaaggaattccggaattccg

SEQ ID NO: 406 - DNA, 1244 bp, Homo sapiens
atggaagccccagctcagcttctcttcctcctgctactctggctcccagataccaccggagaaattgtgttgacacagtctccagccaccctgtctttgtctccaggggaaagagccaccctctcctgcagggccagtcagagtgttggcagctacttagcctggtaccaacagaaacctggccaggctcccaggcccctcatctatgatgcatccaacagggccactggcatcccagccaggttcagtggcagtgggtctgggacagacttcactctcaccatcagcagcctagagcctgaagattttgcagtttattactgtcaacaccgtgacaattggcctccgggggccactttcggcggagggaccaaggtggagatcaaacataccaccggagaaattgtgttgacacagtctccagccaccctgtctttgtctccaggggaaagagccaccctctcctgcagggccagtcagagtgttggcagctacttagcctggtaccaacagaaacctggccaggctcccaggcccctcatctatgatgcatccaacagggccactggcatcccagccaggttcagtggcagtgggtctgggacagacttcactctcaccatcagcagcctagagcctgaagattttgcagtttattactgtcaacaccgtgacaattggcctccgggggccactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgc

SEQ ID NO: 407 - DNA, 2239 bp, Homo sapiens
gaattccgtcccgagctccgcaatgaagacgtgcagctccgactcaacagtattaagaagttatcaacaattgccctagcacttggagtagaaaggacccgaagtgaattgttgccatttcttacagatacaatttatgatgttgatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaaccagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcggctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtattccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttccggaattc

SEQ ID NO: 408 - DNA, 2875 bp, Homo sapiens
gaattctccggagctgaaaaaggatcctgactgaaagctagaggcattgaggagcctgaagattctcaggttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcttgatactccagatccctatgtggaactttttatctctacaacccctgacagcaggaagagaacaagacatttcaataatgacataaaccctgtgtggaatgagacctttgaatttattttggatcctaatcaggaaaatgttttggagattacgttaatggatgccaattatgtcatggatgaaactctagggacagcaacatttactgtatcttctatgaaggtgggagaaaagaaagaagttccttttattttcaaccaagtcactgaaatggttctagaaatgtctcttgaagtttgctcatgcccagacctacgatttagtatggctctgtgtgatcaggagaagactttcagacaacagagaaaagaacacataagggagagcatgaagaaactcttgggtccaaagaatagtgaaggattgcattctgcacgtgatgtgcctgtggtagccatattgggttcaggtgggggtttccgagccatggtgggattctctggtgtgatgaaggcattatacgaatcaggaattctggattgtgctacctacgttgctggtctttctggctccacctggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgacatctttgggatgttaataggagaaacactaattcataatagaatgaatactactctgagcagtttgaaggaaaaagttaatactgcacaatgccctttacctcttttcacctgtcttcatgtcaaacctgacgtttcagagctgatgtttgcagattgggttgaatttagtccatacgaaattggcatggctaaatatggtacttttatggctcccgacttatttggaagcaaattttttatgggaacagtcgttaagaagtatgaagaaaaccccttgcatttcttaatgggtgtctggggcagtgccttttccatattgttcaacagagttttgggcgtttctggttcacaaagcagaggctccacaatggaggaagaattagaaaatattaccacaaagcatattgtgagtaatgatagctcggacagtgatgatgaatcacacgaacccaaaggcactgaaaatgaagatgctggaagtgactatcaaagtgataatcaagcaagttggattcatcgtatgataatggccttggtgagtgattcagctttattcaataccagagaaggacgtgctgggaaggtacacaacttcatgctgggcttgaatctcaatacatcttatccactgtctcctttgagtgactttgccacacaggactcctttgatgatgatgaactggatgcagctgtagcagatcctgatgaatttgagcgaatatatgagcctctggatgtcaaaagtaaaaagattcatgtagtggacagtgggctcacatttaacctgccgtatcccttgatactgagacctcagagaggggttgatctcataatctcctttgacttttctgcaaggccaagtgactctagtcctccgttcaaggaacttctacttgcagaaaagtgggctaaaatgaacaagctcccctttccaaagattgatccttatgtgtttgatcgggaagggctgaaggagtgctatgtctttaaacccaagaatcctgatatggagaaagattgcccaaccatcatccactttgttctggccaacatcaacttcagaaagtacaaggctccaggtgttccaagggaaactgaggaagagaaagaaatcgctgactttgatatttttgatgacccagaatcaccattttcaaccttcaattttcaatatccaaatcaagcattcaaaagactacatgatcttatgcacttcaatactctgaacaacattgatgtgataaaagaagccatggttgaaagcattgaatatagaagacagaatccatctcgttgctctgtttcccttagtaatgttgaggcaagaagatttttcaacaaggagtttctaagtaaacccaaagcatagttcatgtactggaaatggcagcagtttctgatgctgaggcagtttgcaatcccatgacaactggatttaaaagtacagtacagatagtcgtactgatcatgagagactggctgatactcaaagttgcagttacttagctgcatgagaataatactattataagttaggtgacaaatgatgttgattatgtaaggatatacttagctacattttcagtcagtatgaacttcctgatacaaatgtagggatatatactgtatttttaaacatttctcaccaactttcttatgtgtgttctttttaaaaattttttttcttttaaaatatttaacagttcaatctcaataagacctcgcattatgtatgaatgttattcactgactagatttattcataccatgagacaacactatttttatttatatatgcatatatatacatacatgaaataaatacatcaatataaaaataaaaaaaaacggaattc

SEQ ID NO: 409 - DNA, 3178 bp, Homo sapiens
  Modified_base 990, 1015, 1039, 1063, 1065, 1123, 1559, 1564, 1564, 1587, 1590,1596, 1637, 1645, 1649, 1650, 1657, 1665, 1691, 1703, 1721, 1737, 1740,1755, 1759, 1933, 1954, 1967, 1968, 1993, 1997, 2166, 2189, 2207, 2210,2247, 2248, 2394, 2467, 2576, 2580, 2582, 3053, 3148: n = a,c,g, or t
agttgagcgcagtcgccgctccagtctatccggcactaggaacagccccgggggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaagtccaaagagactgcagatgccatcactaaagaagcgaagaaagctaccgtgaatttactgggtgaagaaaagaagagcacctaaaccagactaaaccagactggatggaaacttcctgccctctctgtaccttcctactggagcttgatgttatattagggactgtggtataattattttaataatgttgccttggaaacattttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgnattttctctgtagttacatttaggntaatctttatggttctacttcctntaatgtacaattttatataattcngnaatgtttttaatgtatttgtgcacatgtacatatggaaatgttactgtctgactacancatgcatcatgctcatggggagggagcaggggaaggttgtatgtgtcatttataacttctgtacagtaagaccacctgcaacaagctggaggaaccattgtgctggtgtggtctactaaataatactttaggaaatacgtgattaatatgcaagtgaacaaagtgagaaatgaaatcgaatggagattggcctggttgtttccgtagtatatggcatatgaataccaggatagctttataaagcagttagttagttagttactcactctagtgataaatcgggaaatttacacacacacacacacacacacacacacacacacacacacacacacacacacagagtaccctgtaactctcaattccctgaaaaactagtaatactgtcttatctgctataaactttacatatttgtctattgtcaagatgctacantggannccatttctggttttatcttcanagnggaganacatgttgatttagtcttctttcccaatcttcttttttaanccagtttnaggnncttctgnagatttgnccacctctgattacatgtatgttctngtttgtatcatnagcaacaacatgctaatgncgacacctagctctnagngcaattctgggagantganaggnngtatanagtnncccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacangactacatagtaagtacagancagtaaagttaanncggatgtctccattgatctgccaantcgntatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagntaacaatcaggtaagatcatnacaatgtctcatgatgtnaanaatattaaagatatcaatactaagtgacagtatcacnnctaatataatatggatcagagcatttattttggggaggaaaacagtggtgattaccggcattttattaaacttaaaactttgtagaaagcaaacaaaattgttcttgggagaaaatcaacttttagattaaaaaaattttaagtanctaggagtatttaaatccttttcccataaataaaagtacagttttcttggtggcagaatgaaaatcagcaacntctagcatatagactatataatcagattgacagcatatagaatatattatcagacaagatgaggaggtacaaaagttactattgctcataatgacttacaggctaaaantagntntaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttatcacctatcctgaagatgtgatacactgaatggaaataaatagatgtaaataaaattgagntctcatttaaaaaaaaccatgtgcccaatgggaaaatgacctcatgttgtggtttaaacagcaactgcacccactagcacagcccattgagctancctatatatacatctctgtcagtgcccctc

SEQ ID NO: 410 - DNA, 2228 bp, Homo sapiens
gaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccacaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtattcatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttgggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaaaaaaaaaa

SEQ ID NO: 411 - DNA, 4051 bp, Homo sapiens
ttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggtgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacccaaaactgaaggtccccaaggtcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttgggccaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttaccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggtatctctactccggggtccgacttgcacgtcaatgccaaggggccacaggtttctggcgaactgaaggggccaggtgtggatgtgaacctgaaagggtctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccggaattc

SEQ ID NO: 412 - DNA, 7332 bp, Homo sapiens
ttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgcctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgtgtgcatttttaaattgagagagaacagcaaagccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactttctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacactttaaccggtggcatcatgataccaaacccgctactgatggtgacagctgtacatcaactctgcccctaggatgagcagaagtacctggagcataattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaaaa

SEQ ID NO: 413 - DNA, 1188 bp, Homo sapiens
tcgagatccattgtgctctaaaggctcgccctcctgtgcatcgcggctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccatggcacatatatacaatagtgattggctttagagcacaat

SEQ ID NO: 414 - DNA, 4077 bp, Homo sapiens
gaattcccactctgctgcctgctccagcagacggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtccgaatgttagattcctcttgcctctctcaggagtatcttacctgtaaagtctaatctctaaatcaagtatttattattgaagatttaccataagggactgtgccagatgttaggagaactactaaagtgcctaccccagctc

SEQ ID NO: 415 - DNA, 2517 bp, Homo sapiens
ggaattccgtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagtagctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatctctgcgcgtgggggggctctaactgcactttcggcccttttgctcgtggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggcccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgttaaaaaaaggaattcgatat

SEQ ID NO: 416 - DNA, 1829 bp, Homo sapiens
gggattcgggcctgggactgtgtctgtcgcccatggccgccgcgctgctcgcccgggcctcgggccctgcccgcagagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaactctctctacctggggcccatcttgaagtttggctccaaggagcagaagcaggcgtgggtcacgcctttcaccagtggtgacaaaattggctgctttgccctcagcgaaccagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatgcaaaccctggacatgggccgcatcggcatcgcctcccaggccctgggcattgcccagaccgccctcgattgtgctgtgaactacgctgagaatcgcatggccttcggggcgcccctcaccaagctccaggtcatccagttcaagttggcagacatggccctggccctggagagtgcccggctgctgacctggcgcgctgccatgctgaaggataacaagaagcctttcatcaaggaggcagccatggccaagctggccgcctcggaggccgcgaccgccatcagccaccaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacatgggaatgaggccctccgaccattggcagctccgcctctgggcctttccgcctcctcaccactgtgcctcaagttcctcatctaagtggccctggctcctgggggcggggttgtgggggggctgagcgacactcagggacacctcagttgtcctcccgcgggccctggtgccctggcatgaaggcccagtgcgacaggcccttggtggggtctgtcttttccttgaggtcagaggtcaggagcagggctggggtcaggatgacgaggcctggggtcctggtgttgggcaggtggtggggctgggccatggagctggcccagaggcccctcagccctttgtaaagtctgatgaaggcaggggtggtgattcatgctgtgtgactgactgtgggtaataaacacacctgtccccc

SEQ ID NO: 417 - DNA, 1497 bp, Homo sapiens
accgctggccccagggaaagccgagcggccaccgagccggcagagacccaccgagcggcggcggagggagcagcgccggggcgcacgagggcaccatggcccagacgcccgccttcgacaagcccaaagtagaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaaatttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaactaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggcagggaccagcgcccttgcacatgggcatggttgaatctgaaaccctccttctgtggcaacttgtactgaaaatctggtgctcaataaagaagcccatggctggtggcatgc

SEQ ID NO: 418 - DNA, 4321 bp, Homo sapiens
cgagatcccggggagccagcttgctgggagagcgggacggtccggagcaagcccacaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttagaattccggcggagagaaccctctgttttcccccactctctctccacctcctcctgccttccccaccccgagtgcggagcagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaaacaagcaaacaaaaaaaaaa

SEQ ID NO: 419 - DNA, 1560 bp, Homo sapiens
cgagcccgagtggttcactgcactgtgaaaacagattccagacgccgggaactcacgcctccaatcccagacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttacggcctagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagaaaaaaaaaaaaa

SEQ ID NO: 420 - DNA, 4437 bp, Homo sapiens
gcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacatctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagcttgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccaaaaaaaaaaaaaaaaaaaaa

SEQ ID NO: 421 - DNA, 2016 bp, Homo sapiens
gccagctggagcgttttcggggctgtaaagggagaatggcgcatgcgcatattcagggcggaaggcgcgctaagagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgcggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccaaaaaaaaaaaaaaaaaaaa

SEQ ID NO: 422 - DNA, 5067 bp, Homo sapiens
ctcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacctccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtcagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgccgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcc

SEQ ID NO: 423 - DNA, 1551 bp, Homo sapiens
ggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattct

SEQ ID NO: 424 - DNA, 822 bp, Homo sapiens
gggctgctccacgcttttgccggagacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgt

SEQ ID NO: 425 - DNA, 987 bp, Homo sapiens
cggagagggggagaacagacaacgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatataagccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactc

SEQ ID NO: 426 - DNA, 1689 bp, Homo sapiens
cccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtattcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttccttgcaggggggccagccattgtctcccacttggggagtttcttcctggcatcatgccttctgaataaatgccgattttgtccatgg

SEQ ID NO: 427 - DNA, 2500 bp, Homo sapiens
tatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctatacatctgaagaatcagagaatgaaaaccctcatgcaaggggttcctttagttataagtcactcagaaagggaggaccatcacagagggagcagtacctgcctggtgccattgccatttttaatgtgaacaacagcagcaataaggaccaggaaccagaggaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaacaccacaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagcaccttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctagaagaaaaagggaagcaaattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggaccttggagcgaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacagcccacacctctctgagagatactatgattaaaaaagctttatatctgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacattttta

SEQ ID NO: 428 - DNA, 5460 bp, Homo sapiens
cgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggcccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacagggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaata

SEQ ID NO: 429 - DNA, 2439 bp, Homo sapiens
cagcacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggactggctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcggccgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcgcggcgcacagcgcttctgccccgacggctcgcccagcgagtgccacgagcatgcagactgcgtcctagagcgcgatggctcgcggtcgtgcgtgtgtcgcgttggctgggccggcaacgggatcctctgtggtcgcgacactgacctagacggcttcccggacgagaagctgcgctgcccggagccgcagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagcccaaggggtggccgtcctgagggggaagtgagaagggctcagagaggacaaaataaagtgtgtgtgcaggg

SEQ ID NO: 430 - DNA, 3321 bp, Homo sapiens
atgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaagctggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagagactggagcat

SEQ ID NO: 431 - DNA, 643 bp, Homo sapiens
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgctgtgcccttggggtggaaggggcaggattctgcagctgcttttgcatttctcttcctaaatttcattgtgttgatttctttccttcccaataggtgatcttaattactttcagaatattttcaaaatagatatatttttaaaatccttac

SEQ ID NO: 432 - DNA, 687 bp, Homo sapiens
gcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaacgcagcgaaggccgggaaaaaaa

SEQ ID NO: 433 - DNA, 5128 bp, Homo sapiens
actctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgagttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaagaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgaaaaaa

SEQ ID NO: 434 - DNA, 14069 bp, Homo sapiens
cgttaaatgcaaacgctgctctggctcatgtgtttgctccgaggtataggttttgttcgactgacgtatcagatagtcagagtggttaccacaccgacgttgtagcagctgcataataaatgactgaaagaatcatgttaggcatgcccacctaacctaacttgaatcatgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccgagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 435 - DNA, 6450 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggagctgcacttgctccgtcgggtcgccggcttcaccggaccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgcctttgggggtgccctgggatccctggggtagtccagctcttattcatttcccagcgtggccctggttggaagaagcagctgtcaagttgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccaaggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaataaagtcatacagtagctcaaaaggcaaccataattctctttggtgcaagtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcatttttttgcatccaattgtgcctgaacttttaaaatatgtaaatgctgccatgttccaaacccatcgtcagtgtgtgtgtttagagctgtgcaccctagaaacaacatacttgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaact

SEQ ID NO: 436 - DNA, 3304 bp, Homo sapiens
gcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggagcctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtatgattatcgggaaatgctgcacaatgccactttctgtctggttcctcgtggtcgcaggcttgggtccttcagattcctggaggctttgcaggctgcctgcgtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaaggccaatgagaactcaactcctggctcctgggactgcaccagactgctccaaactcacctcactggcttctgtgtcccaagactaggttggtacagtttaattatggaacattaaataattatttttgaaaaaaaaaaaaaaaaaa

SEQ ID NO: 437 - DNA, 5503 bp, Homo sapiens
agccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacattgctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgaggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaaaaaaaaaaaaaaaaaaaaaaaaaaaaaaaaaaaaaaaaaaaaaaaaaaaaaa

SEQ ID NO: 438 - DNA, 1447 bp, Homo sapiens
agtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgc

SEQ ID NO: 439 - DNA, 723 bp, Homo sapiens
agttgttgcttatgatgtgtgagtgaacatatgccatgcctggccttttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatgaccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttgga

SEQ ID NO: 440 - DNA, 2583 bp, Homo sapiens
gttcccacttcctcccgccccaggaaacctgccatggcctcctggtgagctgtcctcatccactgctcgctgcctctccagatcttcagttgcttcaggccactttgaatgtatatgagccggtcgtaggggatatcgatggcttagcttgggctcagaggcctgaaaatcgcccccaccaatcacctgtttcccccaatctaccctcctgaaggtcactgacaaagacttcattgtctcctaggagaggctgccatatatcagggctgacgtaattccatcttaatatcagttacattataaaaatttacctcgtgcctgaggccccagagcccaagggtgcaaagcagtaattagtcaaagttcaacttcccctcccactctgggctcaggctgtccctgagggcctgtgttttgagtctctttccagaaccttggtgtgaacttaggtcttggcgtcgggatcccttttcgtcacactcaggtgacctacaggctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaattccagcactttgggaggctgaggtaggaggattgattgaggccaagagttaaagaccagcctggtcaatatagcaagaccacgtctctaaataaaaaataataggccggccagca

SEQ ID NO: 441 - DNA, 1361 bp, Homo sapiens
cccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggta

SEQ ID NO: 442 - DNA, 2913 bp, Homo sapiens
gtcccagctagagctccagcgcccgctcaggccccactcgaccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactccaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaagttttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagataggagaatatgtttaaaatattaggaatcctagaccatattttcaagtcatcttagcagctaggattctcaaatggaagtgttatatataatatgttaaaaacattttgctttcctggctaattatttgatccttttaaatccaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaaaaaaaaaaaaaaaaaaaaaaaa

SEQ ID NO: 443 - DNA, 2921 bp, Homo sapiens
ccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagcctctactttcttcttgccacctttttgtggcaatattaaagtgaactgctaatagtgtaagtatgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttaaaaaaaaaaaaaaaaaaaaa

SEQ ID NO: 444 - DNA, 3088 bp, Homo sapiens
acaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacat

SEQ ID NO: 445 - DNA, 5054 bp, Homo sapiens
cgatactacgtgggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccgctgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgctgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaa

SEQ ID NO: 446 - DNA, 1350 bp, Homo sapiens
aggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaa

SEQ ID NO: 447 - DNA, 1987 bp, Homo sapiens
ctcgagagctccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattgtcggctccgacctgggacccctcatggtgactgaagcccttaagccatactcttcaggaggtccccgcgtctggtatgtctccaacattgatggaactcacattgccaaaaccctggcccagctgaacccggagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaacaaagatgccacggaggaggt

SEQ ID NO: 448 - DNA, 1568 bp, Homo sapiens
gaattccggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagctcttcaccaagaagaacatcaattgttccatagaggagagttttcagaggtttgacgcaatcctgaaggcagcgcagtcagccaatatttctgtgcgggggtacgtctcctgtgctcttggctgcccttatgaagggaagatctccccagctaaagtagctgaggtcaccaagaagttctactcaatgggctgctacgagatctccctgggggacaccattggtgtgggcaccccagggatcatgaaagacatgctatctgctgtcatgcaggaagtgcctctggctgccctggctgtccactgccatgacacctatggtcaagccctgaccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccgtctgccaactccagcatctctggaaaatctccacgctgaatgtgatttttgaaaacagcttatgtaattaaaggttgaatggcacatcat

SEQ ID NO: 449 - DNA, 1873 bp, Homo sapiens
cgcgccccaggccggtgtacccccgcactccgcgccccggcctagaagctctctctccccgctccccggcccggcccccgccccgccccgccccagcccgctgggccgccatggagcgctggccttggccgtcgggcggcgcctggctgctcgtggctgcccgcgcgctgctgcagctgctgcgctcagacctgcgtctgggccgcccgctgctggcggcgctggcgctgctggccgcgctcgactggctgtgccagcgcctgctgcccccgccggccgcactcgccgtgctggccgccgccggctggatcgcgttgtcccgcctggcgcgcccgcagcgcctgccggtggccactcgcgcggtgctcatcaccggctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcttgctagagttcaccaaggcccacaccaccagcaccggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggagcccagcgggggacatgccatatccgtgcttgggggcctatggaacctccaaagcggccgtggcgctactcatggacacattcagctgtgaactccttccctggggggtcaaggtcagcatcatccagcctggctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatgggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttcta

SEQ ID NO: 450 - DNA, 2986 bp, Homo sapiens
gcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggcccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtccatgtcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttcacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactattgcagctccagtttcctgcagtgatcagggtcctgcaagcagtggggaagggggccaaggtattggaggactccctcccagctttggaagggtcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttttcagagacggggtctcgcaacattgcccagacttcctttgtgttagttaataaagctttctcaactgcc

SEQ ID NO: 451 - DNA, 2776 bp, Homo sapiens
cagggcagactggtagcaaagcccccacgcccagccaggagcaccgccgcggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacggaaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttggccacagctcttgaggatgtcaccaattaaccagaaatccagttattttccgccctcaaaatgacagccatggccggccggtgcttctgggggctcgtcggggggacagctccactctgactggcacagtctttgcatggagacttgaggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaaataaaacttcaat

SEQ ID NO: 452 - DNA, 5645 bp, Homo sapiens
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactg

SEQ ID NO: 453 - DNA, 1412 bp, Homo sapiens
cggggtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtc

SEQ ID NO: 454 - DNA, 1487 bp, Homo sapiens
ctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttacattaagcctacaacatttttcagtttgcaaatagaactaatactggtgaaaatttacctaaaaccttggttatcaaatacatctccagtacattccgttcttttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacac

SEQ ID NO: 455 - DNA, 3145 bp, Homo sapiens
ggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtgg

SEQ ID NO: 456 - DNA, 2257 bp, Homo sapiens
acggcagccgtcagggaccgtcccccaactcccctttccgctcaggcagggtcctcgcggcccatgctggccgctggggacccgcgcagcccagaccgttcccgggccggccagccggcaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtct

SEQ ID NO: 457 - DNA, 732 bp, Homo sapiens
tgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagc

SEQ ID NO: 458 - DNA, 1418 bp, Homo sapiens
aactgtgcgaaccagacccggcagccttgctcagttcagcatagcggagcggatccgatcggatcggagcacaccggagcaggctcatcgagaaggcgtctgcgagaccatggagaacggatacacctatgaagattataagaacactgcagaatggcttctgtctcatactaagcaccgacctcaagttgcaataatctgtggttctggattaggaggtctgactgataaattaactcaggcccagatctttgactacagtgaaatccccaactttcctcgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttgga

SEQ ID NO: 459 - DNA, 4673 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtcctctcctttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaaaaaaaaaa

SEQ ID NO: 460 - DNA, 3231 bp, Homo sapiens
ctccagggacaggcagccaccatgagcctcagtgaggagcaggcccggagctttctggaccagaaccccgattttgcccgccagtactttgggaagaaactgagccctgagaatgttggccgcggctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgttcttgaagtacctgaattttgccacgttgtacctgaagatctatcacctgagctacctccacaactgcgagacgcgccgcggccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccgtggggaccctatggctccctcaatcttcacccactaggatttgggttctgcctgtggctatttgctacaagaggttaggaagcccaagaaaatgactgaagatcattctggatattttaattttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatgctaatttttgtattttcagtacagatggggtttcaccatattgggcaggctggtctcgaactcctgacctcaggtgatcaccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcag

SEQ ID NO: 461 - DNA, 1472 bp, Homo sapiens
actgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgctt

SEQ ID NO: 462 - DNA, 2609 bp, Homo sapiens
cgcccgggcaggtctcccttcaaacgtggcgtcgtgggttgtttgcgcctcgcctggggtcagcgagcaaggacgggcgcgggcggggatactcaaagccaacagctggagtcagccctcgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaactgaaagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaagtttttgcctatccctttccttaaaatataagaaataaaggagctcttacgaaaaacccaggttagaccgcataaaaaataaagtgaacagtgaggtggtagcaagacttctttttagaaaagaaagcatttacctgcctgtctgtaaggtggaaatttcatcagtttgcaaacgataagaaatgcagacttgctcttgatagaaatgcttagaaacactctgggggggaaaaaagctccttccatatactgtgagacatttgttaagtgacatctattgtttatcagcttttaaggataaaaaaggtattttaaaagttggatatttaggatatttgaggatattcctttatgagctctccatatccttcttgagaaactggttaaaaaaggaataggggtagagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacaagtagattttaagaataaatgtttctggaaaaggactatgttatgattttgtagaaatgtaaagattacttgaggtgtttaaaataaatttttcattcagact

SEQ ID NO: 463 - DNA, 1767 bp, Homo sapiens
aagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattg

SEQ ID NO: 464 - DNA, 2680 bp, Homo sapiens
ggggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggg

SEQ ID NO: 465 - DNA, 854 bp, Homo sapiens
gaattcccaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatcaaaaaaaaaaaaggaattc

SEQ ID NO: 466 - DNA, 2279 bp, Homo sapiens
ggcacgagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgcactacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctatgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaatctcgtgcc

SEQ ID NO: 467 - DNA, 2415 bp, Homo sapiens
cggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtatctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacc

SEQ ID NO: 468 - DNA, 921 bp, Homo sapiens
gtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagttgtggtgacagtacatggagagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcacaaaatgttttggtgtgggattatttgaaagcaaaagaaatctaattttgttttctccattacctcattttagtattaatttttacttggtataatatacatggttaaaatgcttatgtgacttcgagtaggtgaatcttaaagaaataaaattcaagtgaccac

SEQ ID NO: 469 - DNA, 1550 bp, Homo sapiens
gtggcctaccatggtttcaacgggtaacggggaataagggttcgattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctacgatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctagggacaagtgtaatacatttatgtgaagtaagacaatgcgagactggtggccgtcaaatagcatccgtcaatctgtgttaactgcataggaggctctcgatagcacctgctatagcggtgtcatgttggatcgctttgtgactgttcatctgtccttgacagtggctgtcatcttgactactttgttgatttgttggtattggggacattttaaaggctgagttatttttgaatgtcatgtttatgtcatagacgtagaaaacgcatccttgaattaaactgccttaactccttttgtggtataagcaaactacatggactctgtccctggtatccttttcctgtgtggttgcccctgtgcctgtggtctggcctaggttaagtgtgcaagataactactcgtgagttattcagaatgttgttcctaataaatgcacttgttgtctgtcttctttaatcaaatcacatcttatatacagcagtcagagatgagtatactagaatcatggattgctggaggtcttttaatctgatgttctcagaagggggtggatttaaatcctgaaataaatatttcaacac

SEQ ID NO: 470 - DNA, 3637 bp, Homo sapiens
cagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgttctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactcaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggtaagtcccttgacctttccaggcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctgggtgaaggaaggtacaggcaggatgatccagggattgggctg

SEQ ID NO: 471 - DNA, 3936 bp, Homo sapiens
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgacgatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatgatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttttccaattttaccttctttaaaataggttgttggagctttcctcaaagggtatggtcatctgttgttaaattatgttcttaactgtaaccagtttttttttatttatctctttaatcttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctacatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctctttttttttttgtatattattgtttacaataaatatacattgcattaaaaagaaa

SEQ ID NO: 472 - DNA, 4977 bp, Homo sapiens
cggggcccggggggcgggggcctgacggccgggccgggcggcggagctgcaagggacagaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccccgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagctcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgccgtccaaaggcacctactggtggatgaacgccttcatcaagactgcccacaagaagcccatcgacttgcgagccatcgggaagctgcccatcgttatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatgggaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctcgcagtcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagggcacatcatcattgatggcattgacatccgcaaactgccgctgcacaccctgccgtcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcct

SEQ ID NO: 473 - DNA, 1866 bp, Homo sapiens
ccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattgggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcctggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctcctcgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctctgagctggttgtggcacagtagctggggagacctcagcagggctgctcagtgcctgcctctgacaaaattaaagcattgatggcctgtggacctgcaaaaaa

SEQ ID NO: 474 - DNA, 2691 bp, Homo sapiens
gcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctcctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 475 - DNA, 2709 bp, Homo sapiens
gggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccagaggacattgtgtacgtggaccatgaggattggcggcaggagtatgttcttaatgagtctgggagaatttactacgggaccgaagcacagattggtgagcggacctggaactacggccagtttgaccacggggtgctggatgcctgcttatacatcctggaccggcgggggatgccatatggaggccgtggagacccagtcaatgtctcccgggtcatctctgccatggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggagtgaccaccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggaacttccatgtgtggaacgactgctggatgaagaggccggatctgccctcgggctttgatgggtggcaggtggtggatgccacaccccaagagactagcagtggcatcttctgctgcggcccctgctctgtggagtccatcaagaatggcctggtctacatgaagtacgacacgcctttcatttttgctgaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacgttactgggagcagcagtggttggccaggagtgtgaagtacagattgtcttcaagaacccccttcccgtcaccctcaccaatgtcgtcttccggctcgaaggctctgggttacagaggcccaagatcctcaacgttggggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagcttagccctgtgccaggagcaatgggactggagtcagatgagcaaggacattgccccaagataggggcacactacagagcagctccccaggagctcaggtggggagtccagggctcccggagagggagtcagtcttcacttgcactgggggaacagatgctaataaactgttttttaatg

SEQ ID NO: 476 - DNA, 5483 bp, Homo sapiens
  Modified_base 398, 400, 556: n = a,c,g, or t
tctgtcgacttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctcgaaacagcagatggcttccatatccagagagcaagaaccagagagagagagaaagagagagagtttgggtctttctcctctntncctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggngggccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagacggcgcagagcgggcagcaggcaggcggcgggcgctcagacggcttctcctcctcctcttgctcctccagctcctgctccttcgccgggaggccgcccgccgagtcctggccagcgccgaggcagcctgcctgcgccccatcccgtcccgccgggcactcggagggcagcgcgccggaggccaaggttgccccgcacggcccggcgggcgagcgagctcgggctgcagcagccccgccggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccacacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacattttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcacgccatttggcagggggagaatgggaggcttggccttctttgtgaggcagtgtgagcagaagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcttccctattggaatcccaatggctcctggagtaggaaaaaagtttaaactacattcatgttcttgttctgtgtcactcggccctgggtagtctaccatttacttcaccccaagtcctgctgcccatccagttgggaagcccatgattttcctaagaatccagggccataggagatacaattccaagttctcgcttcctcctttgggcatctcttctgcctcccaatcaaggaagctccacgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcac

SEQ ID NO: 477 - DNA, 1229 bp, Homo sapiens
gcgcgacactgaccttcagcgcctcggctcggccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctgggacactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctcgcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctagcactagg

SEQ ID NO: 478 - DNA, 3452 bp, Homo sapiens
atttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttgtgaatcctttggccacattttgccctgcttctctcagggttaagggttctggaagaacattaagaatgagatgcaattgaaaatagtcattttgaatcctattgattattcaaaaattcaggctgattgtcttttatcagaggtaggattctgttttatagtatagaatctactttatcccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaaaa

SEQ ID NO: 479 - DNA, 1669 bp, Homo sapiens
gaaacaagcactggattccatatcccactgccaaaaccgcatggttcagattatcgctattgcagctttcatcataatacacacctttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatc

SEQ ID NO: 480 - DNA, 4266 bp, Homo sapiens
cttcctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatactgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttcctttttatctctcaagccaccagctgccagccaccacgagccagctgccagcctagctttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattctacggggaattcttaaaactgtgctcaactattaaaatgaatgagctttc

SEQ ID NO: 481 - DNA, 2984 bp, Homo sapiens
taactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggatcccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattatatactcagagaacagaagtgcaatgtgatgggaggaacgtagcaatatctgctccttttcgagttgtttgagaaatgtaggctattttttcagtgtatatccactcagattttgtgtatttttgatgtacccacactgttctctaaattctgaatctttgggaaaaaatgtaaagcatttatgatctcagaggttaacttatttaagggggatgtacatattctctgaaactaggatgcatgcaattgtgttggaagtgtccttggtcgccttgtgtgatgtagacaaatgttacaaggctgcatgtaaatgggttgccttattatggagaaaaaaatcactccctgagtttagtatggctgtatatttatgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagatataatggatggtttgtgactatagtgtaaataaatacttttcaacaat

SEQ ID NO: 482 - DNA, 2593 bp, Homo sapiens
ggccagcgcgtctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaattttcatgtatcattatttttacaaggaactatatataagctagcacatgattatccttctgttcttagatctgtatcttcataataaaaaattttgcccaagtcctgtttccttagaatttgtgatagcattgataagttgaaaggaaaattaaatcaataaaggcctttgatacc

SEQ ID NO: 483 - DNA, 2059 bp, Homo sapiens
ccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacatatccagtactcctggttcctaggtgagcaggtgatgccccagggacctttgtagccacttcactttttttcttttctctgccttggtatagcatatgtgttttgtaagtttatgcatacagtaattttaagtaatttcagaagaaattctcgaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 484 - DNA, 1512 bp, Homo sapiens
ctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggagcagccgccccatctgccccacagtctccggcctctccagcctcagccccctgcttcagtcccttccccatgcttccttgcctgatgacaataaagcttgttgactcagctaaaaaaaaaaaaaaa

SEQ ID NO: 485 - DNA, 2529 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagaggaggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatcacagagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatat

SEQ ID NO: 486 - DNA, 2206 bp, Homo sapiens
ctagtctttcagccttcaggctgtttttggcttgaagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagttgcggatccaccctcagcagcagccccaggaggaaagctctccgcagtccgacatcccagctcctcctagttccaaagcccctggaaaaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttc

SEQ ID NO: 487 - DNA, 3337 bp, Homo sapiens
gtcgagcctctagcccgcccgggtttccttcgcagtcgcgcaccgacgctcaaacgcgcgctccaacccgcagcctcctcctgcctcaccgcccgaagatggcggctctcaaactcctctcctccgggcttcggctctgcgcctctgcccgcggatctggggcaacctggtacaagggatgtgtttgttccttttccaccagtgctcatcgccataccaagttttatacagatccagtagaagctgtaaaagacatccctgatggtgccacggttttggttggtggttttgggctatgtggaattccagagaatcttatagatgctttactgaaaactggagtaaaaggactaactgcagtcagcaacaatgcaggggttgacaattttggtttggggcttttgcttcggtcgaagcagataaaacgcatggtctcttcatatgtgggagaaaatgcagaatttgaacgacagtacttatctggtgaattagaagtggagctgacaccacagggcacacttgcagagaggatccgtgcaggcggggctggagttcctgcattttacaccccaacagggtatgggaccctggtacaagaaggaggatcgcccatcaaatacaacaaagatggcagtgttgccattgccagtaagccaagagaggtgagggagttcaatggtcagcactttattttggaggaagcaattacaggggattttgctttggtgaaagcctggaaggcggaccgagcaggaaacgtgattttcaggaaaagtgcaaggaatttcaacttgccaatgtgcaaagctgcagaaaccacagtggtagaggttgaagaaattgtggatattggagcatttgctccagaagacatccatattcctcagatttatgtacatcgccttataaagggagaaaaatatgagaaaagaattgagcgtttatcaatccggaaagagggagatggggaagccaaatctgctaaacctggagatgacgtaagggaacgaatcatcaagagggccgctcttgagtttgaggatggcatgtatgctaatttgggcataggaatccctctcctggccagcaattttatcagcccaaatataactgttcatcttcaaagtgaaaatggagttctgggtttgggtccatatccacgacaacatgaagctgatgcagatctcatcaatgcaggcaaggaaacagttactattcttccaggagcctcttttttctccagcgatgaatcatttgcaatgattagaggtggacacgtcgatctgacaatgctaggagcgatgcaggtttccaaatatggtgacctggctaactggatgatacctgggaagatggtgaaaggaatgggaggtgctatggatttagtgtccagtgcgaaaaccaaagtggtggtcaccatggagcattctgcaaagggaaatgcacataaaatcatggagaaatgtacattaccattgactggaaagcaatgtgtcaaccgcattattactgaaaaggctgtgtttgatgtggacaagaagaaagggttgactctgattgagctctgggaaggcctgacagtggatgacgtacaaaagagtactgggtgtgattttgcagtttcaccaaaactcatgccaatgcagcagatcgcaaattgaaatatggatatttgtaccaggctgcgtgtttttcattttaaacacacaagatttaattgaaaggacatcaataatcataattgtgtatttaacaggtggttttttattagttttcttgtgtttcagactttatgcagccatataaactgttctctaggcatgctgtgacattttaataaaaagcaaaaggagcatttataattatctcatttgttaaggctgagaaggttgtttttataataggtaattatattgaatgcattttcactgaatatggtatgtatgctaaattatatgaacctttccccaagaagggccctagaaattgatgtggctttcctcttaaatattaattattagtcctgaaagaaagataacatatgtgatttttgtggttaggagagttgctgtcatgattgttttttcttcagcctcctctgacttttcttttggggcttcagattttatgattacatcttgtccccctagaacatcccccttcctcccatactgcttttaaacagatgcccaagaaggcaagcaggaatgcctcttgtgggggagggcagggagaaataactagttcaaaccaactatctatctatgctttgcaaagactaaggcgtattataggaagagggctagaaacctaactgattcttctcagttttctcattttaaaacagcccagtattcctttgtatcctcaagggtccttgagaatacttctgttattgaaaccctgtgggctacttgtactgtacctcctctcaagccaagaagggctgtgggataatttaccatgaatccttagtagcaatgacagcagagttaaaaaataaaaggtgttttactttcaggctcttgttttggttcagaggagattttaaatattgaatgacacttctacagaacaacggtttttcttctgccaaggctacttcctttaacgaagtgcctttaattcagccttatccaactagggaaaataatgttggacaagtctaggatttgaagagtcagtgaacttttagtgtcagggaataaacatggtgggtagattaggtttgaaaaaaacttccttagaggtatttattctcaatacctgacaggggcccatgggaatgacttcagaagcatcccggataatagatgggtaaaaagtctaggcaccctgaagaacaggtgagacagctggcctctggacagaggtaggcatagtacagtacgatatatcattcctctggtcctaaatatacaaacttattcatgtttttaggtgatgatggtcattgaaactcacttcttttcaggtgtagctacaattgtgtaatgtacaatattagagaaaggacaggctttttatgagtaacacacaccatatataaaacagcctttctggctgaccacatggttaaatgcataccttcccagtactggggggaaaatgacccttcttagaatgtgcaagttccatagagtaatatattgatatgattttgaaaagaattgttgatagttacatcttcaaacttatcattccagtatgcatctttaagataatgtgattctaagtagatgactttatattcttgattaaagagtgctatacatgttaagaaatgcattaaggaatacaataaatattctaaactgatgaaaaaaaaaaaaaaaaa

SEQ ID NO: 488 - DNA, 3834 bp, Homo sapiens
cctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagctgtgagatgcgatgctgtccaccagcccccgaagggtttggtgaggtgtgctcattcccctattggagaattcacctacaagtcctcttgtgccttcagctgtgaggagggatttgaattatatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagacggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatgtgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaaagtttcagagaagttctggctgaacactggcaacgacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 489 - DNA, 2628 bp, Homo sapiens
atggagaagctgcaccagtgttattggaaatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcggaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaa

SEQ ID NO: 490 - DNA, 5076 bp, Homo sapiens
atgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtcctacaggttttcaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataa

SEQ ID NO: 491 - DNA, 1476 bp, Homo sapiens
ggcctggcccagttgcaccacgagcgctgcggacactcggggcggcagtcggtctgtcagtcctcccgccaggtcccgcggcccgcacctgccgcccgcacctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgctaaggactttgaccctgccgtcactgagtacatccagaggaagaagttcccccagataattcagctccttatggggcccggtatgtgggctccatggtggctgatgttcatcgcactctggtctacggagggatatttctgtaccccgctaacaagaagagccccaatggaaaggctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgtatctggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaa

SEQ ID NO: 492 - DNA, 1419 bp, Homo sapiens
atgactacctgcagccgccagttcacctcctccagctccatgaagggctcctgcggcatcgggggcggcatcggggcgggctccagccgcatctcctccgtcctggccggagggtcctgccgcgcccccaacacctacgggggcggcctgtctgtctcatcctcccgcttctcctctgggggagcctatgggttggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactga

SEQ ID NO: 493 - DNA, 2383 bp, Homo sapiens
ctccttcaagccctcagtcagttgtgcaggagaaagggggcggttggctttctcctttcaagaacgagttattttcagctgctgactggagacggtgcacgtctggatacgagagcatttccactatgggactggatacaaacacacacccggcagacttcaagagtctcagactgaggagaaagcctttccttctgctgctactgctgctgccgctgcttttgaaagtccactcctttcatggtttttcctgccaaaccagaggcacctttgctgctgccgctgttctctttggtgtcattcagcggctggccagaggatgagactccccaaactcctcactttcttgctttggtacctggcttggctggacctggaattcatctgcactgtgttgggtgcccctgacttgggccagagaccccaggggaccaggccaggattggccaaagcagaggccaaggagaggccccccctggcccggaacgtcttcaggccagggggtcacagctatggtgggggggccaccaatgccaatgccagggcaaagggaggcaccgggcagacaggaggcctgacacagcccaagaaggatgaacccaaaaagctgccccccagaccgggcggccctgaacccaagccaggacaccctccccaaacaaggcaggctacagcccggactgtgaccccaaaaggacagcttcccggaggcaaggcacccccaaaagcaggatctgtccccagctccttcctgctgaagaaggccagggagcccgggcccccacgagagcccaaggagccgtttcgcccaccccccatcacaccccacgagtacatgctctcgctgtacaggacgctgtccgatgctgacagaaagggaggcaacagcagcgtgaagttggaggctggcctggccaacaccatcaccagctttattgacaaagggcaagatgaccgaggtcccgtggtcaggaagcagaggtacgtgtttgacattagtgccctggagaaggatgggctgctgggggccgagctgcggatcttgcggaagaagccctcggacacggccaagccagcggcccccggaggcgggcgggctgcccagctgaagctgtccagctgccccagcggccggcagccggcctccttgctggatgtgcgctccgtgccaggcctggacggatctggctgggaggtgttcgacatctggaagctcttccgaaactttaagaactcggcccagctgtgcctggagctggaggcctgggaacggggcagggccgtggacctccgtggcctgggcttcgaccgcgccgcccggcaggtccacgagaaggccctgttcctggtgtttggccgcaccaagaaacgggacctgttctttaatgagattaaggcccgctctggccaggacgataagaccgtgtatgagtacctgttcagccagcggcgaaaacggcgggccccactggccactcgccagggcaagcgacccagcaagaaccttaaggctcgctgcagtcggaaggcactgcatgtcaacttcaaggacatgggctgggacgactggatcatcgcaccccttgagtacgaggctttccactgcgaggggctgtgcgagttcccattgcgctcccacctggagcccacgaatcatgcagtcatccagaccctgatgaactccatggaccccgagtccacaccacccacctgctgtgtgcccacgcggctgagtcccatcagcatcctcttcattgactctgccaacaacgtggtgtataagcagtatgaggacatggtcgtggagtcgtgtggctgcaggtagcagcactggccctctgtcttcctgggtggcacatcccaagagccccttcctgcactcctggaatcacagaggggtcaggaagctgtggcaggagcatctacacagcttgggtgaaaggggattccaataagcttgctcgctctctgagtgtgacttgggctaaaggcccccttttatccacaagttcccctggctgaggattgctgcccgtctgctgatgtgaccagtggcaggcacaggtccagggagacagactctgaatgggactgagtcccaggaaacagtgctttccgatgagactcagcccaccatttctcctcacctgggccttctcagcctctggactctcctaagcacctctcaggagagccacaggtgccactgcctcctcaaatcacatttgtgcctggtgacttcctgtccctgggacagttgagaagctgactgggcaagagtgggagagaagaggagagggcttggatagagttgaggagtgtgaggctgttagactgttagatttaaatgtatattgatgagataaaaagcaaaactgtgcct

SEQ ID NO: 494 - DNA, 1480 bp, Homo sapiens; identical to SEQ ID NO: 404

SEQ ID NO: 495 - DNA, 1497 bp, Homo sapiens
accaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttctctgaag

SEQ ID NO: 496 - DNA, 3655 bp, Homo sapiens
cttcagatagattatatctggagtgaaggatcctgccacctacgtatctggcatagtattctgtgtagtgggatgagcagagaacaaaaacaaaataatccagtgagaaaagcccgtaaataaaccttcagaccagagatctattctccagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttggtttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatataggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttcta

SEQ ID NO: 497 - DNA, 1639 bp, Homo sapiens; identical to SEQ ID NO: 396

SEQ ID NO: 498 - DNA, 1367 bp, Homo sapiens
ccggccggccgaagagttcacaagtgtgaagcctgaagccgccgggtgccgctgtgtagaaagaagctaaagcacttccagagcctgctgagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaac

SEQ ID NO: 499 - DNA, 5235 bp, Homo sapiens
atgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggatcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtga

SEQ ID NO: 500 - DNA, 2824 bp, Homo sapiens
gcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccagacccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtagcagctgcctccaggatgagttacttgaaatttgccttgagtgtgttacctcctttccaagctcctcgtgataatgcagacttcctggagtacaaacacaggatttgtaattcctactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgt

SEQ ID NO: 501 - DNA, 1585 bp, Homo sapiens
cacaccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagtcccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggaggctgaacaataggctgttcccatgtagccccctggcctctgtgccttcttttgattatgttttttaaaatattatctgattaagttgtctaaacaatgctgatttggtgaccaactgtcactcattgctgaggcctctgctccccagggagttgtgtctgtaatcggcctactattcagtggcgagaaataaaggttgcttaggaaagaa

SEQ ID NO: 502 - DNA, 1433 bp, Homo sapiens
attcggggcgagggaggaggaagaagcggaggaggcggctcccgctcgcagggccgtgcacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggcttgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagt

SEQ ID NO: 503 - DNA, 1722 bp, Homo sapiens; identical to SEQ ID NO: 124

SEQ ID NO: 504 - DNA, 1125 bp, Homo sapiens
ttctgccctcgagcccaccgggaacgaaagagaagctctatctcgcctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattc

SEQ ID NO: 505 - DNA, 803 bp, Homo sapiens
gcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttggggccatcctgcccctccaacccgacatgtgtacctcagctttttccctcacttgcatcaataaagcttctgtgtttggaacagct

SEQ ID NO: 506 - DNA, 1356 bp, Homo sapiens
ttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctcccccc

SEQ ID NO: 507 - DNA, 5075 bp, Homo sapiens
tgaattcggcacgaggtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgtaccctctgtctgttcacctcaccaagcagctctgctgttgtagtgtgggcaaggctgggccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacggggccaggagtgcggagccagaagtggcaactgcaccccctgaaaaggaaataccttcattggatcaagagaaaaccaaacttgagcctggtcaaccccagctgtctccaggcatttccgctattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgcttggatgggtatcacttggatactgccaagatgacctgtttcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgttttttttactattgcttgattaaatttggcatttaaatagtggtggaaatatttttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaat

SEQ ID NO: 508 - DNA, 6030 bp, Homo sapiens
gttggcccccgttacttttcctctgggaaatatggcgcacgctgggagaacagggtacgataaccgggagatagtgatgaagtacatccattataagctgtcgcagaggggctacgagtgggatgcgggagatgtgggcgccgcgcccccgggggccgcccccgcgccgggcatcttctcctcgcagcccgggcacacgccccatacagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccaggcagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgttccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgcttttaatataaagcctgttttgtcttctgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaatcaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaacaatttttaaatataaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 509 - DNA, 1026 bp, Homo sapiens
cagcatgttgagccgggcagtgtgcggcaccagcaggcagctgcctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaactggactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctag

SEQ ID NO: 510 - DNA, 1909 bp, Homo sapiens
gaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagagtctaccagccagatgcacacagcatcatctttggagaagcaaataggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaaaaaaaaaaaaaaaaaaaaaaaaaaaaaaaaaaaaaaaaaaaaaaaaaaa

SEQ ID NO: 511 - DNA, 2232 bp, Homo sapiens
ggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttgctatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctaatttgccagtgggaactcctaaatcaaattggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaag

SEQ ID NO: 512 - DNA, 2324 bp, Homo sapiens
ctccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaa

SEQ ID NO: 513 - DNA, 873 bp, Homo sapiens
atggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttag

SEQ ID NO: 514 - DNA, 1705 bp, Homo sapiens
ggctcactgcatctccggctcctggactcaagcgattctcctgcctcaggctcccaaggtggcagcacgcaaagggtgtccctgtccctcaaggggtcatggcctccatgttgctcgcccagcggctggcctgcagcttccagcacacgtaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgttcccataggttacagcgacccggccctcgtgaaactcatccaacagccacaaaatgcgagcatgtttgtcaacagacccgccctcgaaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggattctccaaagaggagctggagacgtgcatgattaaccaggccccctggtgccccgactacagcatcctctccttcatgggttccttccatgggaggaccatgggttgcttagcgaccacgcactctaaagccattcacaagatcgatatcccttcctttgactggcccatcgcaccgttcccacggctgaaataccctctggaagagtttgtgaaagagaaccaacaggaagaggccggctgtctggaagaggttgaggatctgattgtgaaatatcgaaaaaagaagaagacggtggccgggatcatcgtggagcccatccagtccgagggtggagacaaccatgcatccgatgacttctttcggaagctgagagacatcgccaggaagcactgctgcgccttcttggtggacgaggtccagaccggaggaggctgcacgggcaagttctgggcccatgagcactggggcctggatgacccagcagacgtgatgaccttcagcaagaagatgatgactgggggcttcttcctcaaggaggagttcaggcctaatgctccctaccggatcttcaacacgtggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtgttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtggaatt

SEQ ID NO: 515 - DNA, 1415 bp, Homo sapiens
gggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggcagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaca

SEQ ID NO: 516 - DNA, 1733 bp, Homo sapiens
gggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatg

SEQ ID NO: 517 - DNA, 2347 bp, Homo sapiens
attcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgc

SEQ ID NO: 518 - DNA, 3442 bp, Homo sapiens
agccggtgcgccgcagactagggcgcctcgggccagggagcgcggaggagccatggccaccgctaacggggccgtggaaaacgggcagccggacgggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtatgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcactttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttgggaatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttggcttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgaga

SEQ ID NO: 519 - DNA, 1574 bp, Homo sapiens
acttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaattacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaacgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctc

SEQ ID NO: 520 - DNA, 1399 bp, Homo sapiens
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagac

SEQ ID NO: 521 - DNA, 1070 bp, Homo sapiens
ggggtggcgcccggagctgcacggagagcgtgcccgtcagtgaccgaagaagagaccaagatgaatgcagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgaaagggtcgctcctcttcacatctgacccgttggaagaagaccggtttggcttccctgcattcagcggcatctctcgactgacctggctggtctccctctttggggagctttctcttgtgtctgccactttggaagagcgaaaggaagatcagtatatgaaaatgacagtgtgtctggagacagagaagaaaagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaaaaaaaaaaaaaaaaa

SEQ ID NO: 522 - DNA, 1258 bp, Homo sapiens
cggcttgtcacctgccctaggagacgcagccgccggaccctgcccagggcacccacgcctcggcgaccaccatgtcccagaccaaaatgctgaaggtccgcgtgaccctcttctgcatcctggcaggcatcgtgctggccatgacagccgtggtaaccgaccactgggctgtgctgagcccccacatggagcaccacaacactacctgcgaggcggcccacttcggcctctggcggatttgtaccaagcgcatccccatggacgacagcaagacctgcgggcccatcaccctgcccggggagaagaactgttcctacttcaggcattttaaccccggcgagagctcggagatcttcgaattcaccactcagaaggagtacagcatctcggcagccgccatcgccatcttcagccttggcttcatcatcctgggcagcctctgtgtcctcctgtccctcgggaagaagagggactatctgctgcgacccgcgtccatgttctatgcctttgcaggtctctgcatcctcgtctcggtggaggtcatgcggcagtcggtgaagcgcatgattgacagtgaggacaccgtctggatcgagtactattactcctggtcctttgcctgcgcctgtgccgccttcatcctcctctttctcggcggtctcgccctcctgctgttctccctgcctcgaatgccccggaacccatgggagtcctgcatggatgctgagcccgagcactaaccctctgcggccctagcgaccctcaggcttcttccccaggaagcggggtcttggcctggaaccttccagagaggaggcgggagcaattttagccccaccctgctcccatctgcccccctgcaacagctgcaggctgcttcctctctctgagttcctctgggctgcgcaggctcccctgggaatagagcaagacgtgagtcctaacctggccacagttgggggagcagagccagcaggtggacaggtgtttgcaggggcccaacttcccctggagctcagaggggggcccactgtaccagcctctgataagctgcctccagttgtcctttatgaacattgcagggacaacctgtgtttgccagctgggtgttccgtgtaaatagccagcctgtctctttctcggtgataaaacacacgcgctcctggagcccaggcctccccctccttggcttccaggagcctggaagcatttttaactgggtagaatctgactgtggcttgaaataaaaagctctcag

SEQ ID NO: 523 - DNA, 516 bp, Homo sapiens
atggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtga

SEQ ID NO: 524 - DNA, 1723 bp, Homo sapiens
gggggagtgcgaatttcttggcctgtcggcaggtgctttctcaaaggccccacagtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctgccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacagtgtggttacacagtgtgaataaagtgctgcggagcaagaggaggccgttgattcacttcacgctttcagcgaatgacaaaatcatctttgtgaaggcctcgcaggaagacgcaacacatgggacctataactgcccagcggacagtggcaggacaggaaaaacccgtcaatgtactagggtactgctgcgtcattacagggcacaggccatggatggaaaacgctctctgctctgctttttttctactgttttaatttatactggcatgctattgccttcctattttgcataataaatgcttcagtgaaaatgcagctttactctaa

SEQ ID NO: 525 - DNA, 3050 bp, Homo sapiens
cagaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatcttggctcactgcaacctccacccccggggatcaagcaactctcctgcctcagcctccctagaggctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagccgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaacagaatcatacaatatttgatttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttcctaagtgctgatattacaggcataatatgtgatcttttgtgtctggttgctttcatgttgaatgctatttttgaggttcgtgcctgttgtagaccacagtcacacactgctgtagtcttcccgagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctccccacgtc

SEQ ID NO: 526 - DNA, 2059 bp, Homo sapiens
gtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggaaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttcttattgg

SEQ ID NO: 527 - DNA, 2460 bp, Homo sapiens
aaagtcaaaccccgacaccgcggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcgctgcagggaagtcaacatttgtgaatatccttaaacaattgtgtgaagattgggaagtggttcctgaacctgttgccagatggtgcaatgttcaaagtactcaagatgaatttgaggaacttacaatgtctcagaaaaatggtgggaatgttcttcagatgatgtatgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatatttttgcatctaatttgtatgaatctgaatgcatgaatgagacagagtggacaatttatcaagactggcatgactggatgaataaccaatttggccaaagccttgaattggatggaatcatttatcttcaagccactccagagacatgcttacatagaatatatttacggggaagaaatgaagagcaaggcattcctcttgaatatttagagaagcttcattataaacatgaaagctggctcctgcataggacactgaaaaccaacttcgattatcttcaagaggtgcctatcttaacactggatgttaatgaagactttaaagacaaatatgaaagtctggttgaaaaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgatcagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacctttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattattt

SEQ ID NO: 528 - DNA, 944 bp, Homo sapiens
tcaagattaaacgacaaggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgg

SEQ ID NO: 529 - DNA, 2106 bp, Homo sapiens
gagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaaccctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttc

SEQ ID NO: 530 - DNA, 1266 bp, Homo sapiens
ctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctgtggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactgtggcatttccctactccccaactgagttcaagggctgtaggttcatgcccaagccctgagagtgggtactagaaaaaacgagattgcacagttggagagagcaggtgtgttaaatggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttggcaattgcttattgaaactcattaaaaataatagagccccacttgacactattcactaaaattaatctggaatttaaggcccaacattaaacacaaagctgtattgat

SEQ ID NO: 531 - DNA, 737 bp, Homo sapiens
ggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagcgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagct

SEQ ID NO: 532 - DNA, 1296 bp, Homo sapiens
gcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcgtcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcactaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagttacaaaagaaaaaaaaaaaaaaaaaaaaaaaaaaaaaaaaaa

SEQ ID NO: 533 - DNA, 4034 bp, Homo sapiens
gcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcccgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttataaagaaaaatctttgttactctgtaaatgaaaaaacccattttcgctataaataaaaggtaactgtacaaaataagtacaat

SEQ ID NO: 534 - DNA, 1654 bp, Homo sapiens
gaattcgggcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagccccccgcagcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagacccgaattc

SEQ ID NO: 535 - DNA, 2397 bp, Homo sapiens
gcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatcccctttcgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgca

SEQ ID NO: 536 - DNA, 2447 bp, Homo sapiens
cccggcaaccacgagcccagccaatcagcgccccggactgcaccagagccatggtcggcagaagagcactgatcgtactggctcactcagagaggacctccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgaccgtattcgtgcatttttggatgcatttttaactgattcttatgattactatcatggcatataaccaaaatccgactgggctcaagaggccacttagggaaagatgtagaaagatgctagaaaaatgttctttaaaggcatctacacaatttaattcctctttttagggtcaaagtttagggtacagttggctaggtatcattcaactctccaatgttctattaatcacctctctgtagtttatggtcagaagggaattgctcagagaaggtaaaagactgaatctacctgcctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaattttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattccaagaaaggaaatagtaccttcaatacttaaaaatagtcttccacaaaaaatactttatttctgatctatacaaattttcagaaggttattttctttatcattgctaaactgatgacttaccatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacatatccacaatagctgacggctgggtgtttcagtttgcaaaatattttgttgccttcatcttcactgcaattttgtgtaaatttctcaaagatctaattaaataaataaaattcatttctacagactca

SEQ ID NO: 537 - DNA, 1752 bp, Homo sapiens
ggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccacttttttttttctgcctgagattctttaaggagatagacgggttgaaagacatcaatgaaac

SEQ ID NO: 538 - DNA, 2752 bp, Homo sapiens
cattcccacccttccttctttaataagcaggagcgaaaaagacaaattccaaagaggattgttcagttcaagggaatgaagaattcagaataattttggtaaatggattccaatatcgggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattacgatgcgctgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtcttgaagtcattcagaagtggtttgaggtttctgttttttggtggtttttgtttgttttttttttttttcaccttaagggaggctttcatttcctcccgactgattgtcacttaaatcaaaatttaaaaatgaataaaaagacatacttctcagctgcaaatattatggagaattgggcacccacaggaatgaagagagaaagcagctccccaacttcaaaaccattttggtacctgacaacaagagcattttagagtaattaatttaataaagtaaattagtattgctgcaaatagctaaattatatttatttgaattgatggtcaagagattttccattttttttacagactgttcagtgtttgtcaagcttctggtctaatatgtactcgaaagactttccgcttacaatttgtagaaacacaaatatcgttttccatacagcagtgcctatatagtgactgattttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttctgaggagtctctttcagtttcattttttctcatcccatgacttccctccgatggt

SEQ ID NO: 539 - DNA, 3014 bp, Homo sapiens
ctgaccagcgccgccctcccccgcccccgacccaggaggtggagatccctccggtccagccacattcaacacccactttctcctccctctgcccctatattcccgaaaccccctcctccttcccttttccctcctccctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtgg

SEQ ID NO: 540 - DNA, 2519 bp, Homo sapiens
acagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcc

SEQ ID NO: 541 - DNA, 2461 bp, Homo sapiens
ctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtggcattttcccagatacttcccattttggaagatttcaggacttggtctgatttcaggatactctgtcagatgggaagacatgaatgcacactagcctctccaggaatgcctcctccctgggcagaaatggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagcggctcaaagttggggcaggctggctggcccgtcatgttcctcaaaagagcccttgacgtcaagtctccttcccctttccccactccctggctctcagaaggtattccttttgtgtacagtgtgtaaagtgtaaatcctttttctttataaactttagagtagcatcgagagaattgtatcatttgaacaactaggcttcagcaatatttatagcaatccatagttagtttttacttttcgttgccacaaccctgttttatactgtacttaataaattcagatatatttttcacagtttttcc

SEQ ID NO: 542 - DNA, 2306 bp, Homo sapiens
ggtttcatatgaactctcccgccacccgggaacagctggctgccaccgtttgtgttttccgagtttgtattcttgcaggtgaccaagatggagttttctggaagaaagcggaggaagctgaggttggcaggtgaccagaggaatgcttcctaccctcattgccttcagttttacttgcagccaccttctgaaaacatatctttaacagaatttgaaaacttggctattgatagagttaaattgttaaaatcagttgaaaatcttggagtgagctatgtgaaaggaactgaacaataccagagtaagttggagagtgagcttcggaagctcaagttttcctacagagagaagctagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctataagtgatgaagagaagactcttcgagaacaggagattgttgcctcatcaccaagtttaagtggacttaagttggggttcgagtccatttataagatcccttttgctgatgctctggatttgtttcgaggaaggaaagtctatttggaagatggctttgcttacgtaccacttaaggacattgtggcaatcatcctgaatgaatttagagccaaactgtccaaggctttggcattaacagccaggtccttgcctgctgtgcagtctgatgaaagacttcagcctctgctcaatcacctcagtcattcctacactggccaagattacagtacccagggaaatgttgggaagatttctttagatcagattgatttgctttctaccaaatccttcccaccttgcatgcgtcagttacataaagccttgcgggaaaatcaccatcttcgtcatggaggccgaatgcagtatggcctatttctgaagggcattggtttaactttggaacaggcattgcagttctggaagcaagaatttatcaaaggaaagatggatccagacaagtttgataaaggttactcttacaacatccgtcacagctttggaaaggaaggcaagaggacagactatacacctttcagttgcctgaagattattctgtccaatccaccaagccaaggggattatcatgggtgcccattccgtcacagtgatccagagctgctgaagcaaaagttgcagtcatacaagatctctcctggagggataagccagattttggatttagtaaaggggacacattaccaggtagcctgtcaaaaatactttgagatgatacacaatgtggatgattgtggcttttctttgaatcatcctaatcagttcttttgtgagagccaacgtattctaaatggtggtaaagacataaagaaggaacctatccaaccagaaactcctcaacccaaaccaagtgtccagaaaaccaaggatgcatcatctgctctggcctctttaaattcctctctggaaatggatatggaaggactagaagattactttagtgaagattcttaggcagttttataaccctttttcctcaatagcctgtttcctgtttttaagattttgcctttgttgttgaaaaagggtttcactgtcaccaaggcttagtgcagtgacacaattacagctgattgcagccttgaccttcccagctcaagtgatcctcctacctcagcctcccaagtagttaggacacacaggtgtgcacctcatatccagataatttttttcaatttttttttgtagaggtggggggtctccctatgttgcccaggcagatctcagactcctgggctcaagcgatcctcacacctcagcgtcccagagtgctgggattacagttgtgagccactgtgcctggcctttttttttttttaaccttttcgtttaacttctctcttcactgcatcccaatccatctacaggcatgcacacttattaggaaaggaggtttgaggtaacaacagagactttcactatattttgctttgacagaaggaaagaggaggagtttctattaaaatctgtcacttgagtgatgtcatttaagtcctattttaggagataaaaacagctttggggactggttaaagtcccccagaaactacaataaagaacaacttttgttttaactcttaatcactttgtaattttgactcaatccttttctggaccatttttgttaataaatatcaaagtgt

SEQ ID NO: 543 - DNA, 2723 bp, Homo sapiens
ggaggctgaaatccccagacgccggttttctgggctgggctttctgcttactcactccttctccctctttctggattttaccgaccgttcgcgaaacagctttccacacaatggagcttcatgtcctcgtgcaggaagtactcatcgactgatgtggcagactttgctccctgacaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaat

SEQ ID NO: 544 - DNA, 4490 bp, Homo sapiens
cacgcgtccgcgagtagcggagcgggacccgctgatgctcaccccatttagagaaagaaatccacctccccaaccccaatcaagaacctgctattgtatatcatcatagagccagattacctagggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttatattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaaccc

SEQ ID NO: 545 - DNA, 647 bp, Homo sapiens
gctcctcctgcacacctccctcgctctcccacaccactgcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaatag

SEQ ID NO: 546 - DNA, 2907 bp, Homo sapiens
gccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattct

SEQ ID NO: 547 - DNA, 987 bp, Homo sapiens
gagcagcggacgccggtctctgttccgcagatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcacgttatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaactaaaaa

SEQ ID NO: 548 - DNA, 578 bp, Homo sapiens
cggacgcgtgggcttttcacaaaatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaaaagcgctcccaggagaaacaagcttgaccactatgctatcatcaattttccgctgaccactgagtctgccatgaagaagatagaagacaacaacacacttgtgttcattgtggatgttaaagccaacaagcaccagattagtcaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaaaaaaaaaaaaaaaaaaaaaaa

SEQ ID NO: 549 - DNA, 512 bp, Homo sapiens
cttttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttt

SEQ ID NO: 550 - DNA, 888 bp, Homo sapiens
aagacggaggtcctctttccttgcctaacgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggatt

SEQ ID NO: 551 - DNA, 534 bp, Homo sapiens
ctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaa

SEQ ID NO: 552 - DNA, 620 bp, Homo sapiens
gggtttatcggaaaatgtgtttattgagatggtttcccactcatcttgactcagagtgcttttagtgctgcttcctcctgaaggaacatccttctgtaagccttgcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcatgtgt

SEQ ID NO: 553 - DNA, 2222 bp, Homo sapiens
gagtcccggcagtgcgggactccggtagccgcccctccggtagccgcccctcctccccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcggaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtgcttaatttacccgtttctgatgcgaggaggaaagcctatgccactgttggcatgtacaatggcgattatgttctgtacctgtaacggctatttgcaaagcagatacttgagccattgtgcagtgtatgctgatgactgggtaacagatccccgttttctaataggttttggcttgtggttaacaggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccatagaggctgggggtagccattgtgcagtcatggcccgggggaaacttgccaaccttcgtgtcaggtgctgtgtataagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttgaatgcttcatgacttgaattctactttgataaaaacattgccatactgctttttatcttgatgaattcatctggcattgctttgccttatcatctcatctggagtttttaaatgccatttgtttcagttgtctttaacaacataataaatagactttgccatttaaaaaaaaaaaaaaaaaaaaaaa

SEQ ID NO: 554 - DNA, 1396 bp, Homo sapiens
gcattccccacacaacacccacactcagccactgcgggcgaggagggcacgaggccaggttcccaagagctcaggtttgtcctggaacccagatggactgtggccgggcaagtggatcacaggcctggccagcctaggagttgccacatgtgaggggccgaggggctcaaggaggggaacatcggggagaggagcctactgggtggaggctgggggtcccagcaggaaatggtgagacaaagggcgctggctggcaggaagacagcacaggaaggtcctagaggttcctcagtgcagctggactctcctggagaccttcacacaccctgacatctgggccccgttccacgagggtgctttcactggtctgcaccatggcccaggccctgggattttgaacagctccgcaggtgaatgaaaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggttcctggagtcactgcagagggagtgtgcgaatcaagcctgaccaagaggctccagaataaagtatgatttgtgttc

SEQ ID NO: 555 - DNA, 3683 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttggggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgcccagctctggcttccagaaaaccccagcatccttttctgcagaggggctttctggagaggagggatgctgcctgagtcacccatgaagacaggacagtgcttcagcctgaggctgagactgcgggatggtcctggggctctgtgtagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaaaagcaccgcctccaaatgctaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttaaaaaaaa

SEQ ID NO: 556 - DNA, 1536 bp, Homo sapiens
ggggggggggggaccacttggcctgcctccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagcttgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttatagttgttttatatgttgctataataaagaagtgttctgc

SEQ ID NO: 557 - DNA, 3103 bp, Homo sapiens
actccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaatta

SEQ ID NO: 558 - DNA, 1534 bp, Homo sapiens
ggaattccctggagcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccttgataagaatgtcatcttctccccactgagcatctccaccgccttggccttcctgtctctgggggcccataataccaccctgacagagattctcaaggcctcgagttcacctcacggagacttactgaggcagaaattcactcagagcttccagcacctccgcgcaccctcaatcagttccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccccgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggtcgtgtctgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccagcaagcctagagcttgcatcaagcagtggggctctcagtaaggaacttggaatgcaagctggatgcctgggtctctgggcacagctggcccctgtgcaccgtagtggccatggcatgtgtggccctgtctgcttatccttggaaggtgacagcgattccctgtgaagctctcacacgcacaggggcccatggactcttcagtctggagggtcctggcctcctgacagcaataaataatttcgttggcc

SEQ ID NO: 559 - DNA, 6491 bp, Homo sapiens
ccgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgtttcctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaactaacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagcccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctcccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacacaaaaaaaaaaaaaaaaaaaaaaaa

SEQ ID NO: 560 - DNA, 3236 bp, Homo sapiens
gacccggccatgcgcggcctcgggctctggctgctgggcgcgatgatgctgcctgcgattgcccccagccggccctgggccctcatggagcagtatgaggtcgtgttgccgcggcgtctgccaggcccccgagtccgccgagctctgccctcccacttgggcctgcacccagagagggtgagctacgtccttggggccacagggcacaacttcaccctccacctgcggaagaacagggacctgctgggttccggctacacagagacctatacggctgccaatggctccgaggtgacggagcagcctcgcgggcaggaccactgcttataccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactactgtggggtttgccagggtgtccgccatgtgctcccacagctcaggggctgtgaaccaggaccacagcaagaaccccgtgggcgtggcctgcaccatggcccatgagatgggccacaacctgggcatggaccatgatgagaacgtccagggctgccgctgccaggaacgcttcgaggccggccgctgcatcatggcaggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcctcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagccttccacggtccagctagtgccgctcagccctagaccctgactttgcaggctcagctgctgttctaacctcagtaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctccgtgctcttcgagagggtgtcagtgagcagactgcaccccaagctcccgactccaggtcccctgatcttgggcctgtttcccatgggattcaagagggacagccccagctttgtgtgtgtttaagcttaggaatgccctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 561 - DNA, 1314 bp, Homo sapiens
atggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcaatttgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 562 - DNA, 1449 bp, Homo sapiens
ctggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaacc

SEQ ID NO: 563 - DNA, 877 bp, Homo sapiens
cctcctacctccttctgcttcggtgcgtttgcttctgaggttctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccaagtaagtgtaccttgtactttataaataaacctcaagcagctca

SEQ ID NO: 564 - DNA, 3165 bp, Homo sapiens
gaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggtccctgtctcagaaaggagtcttgctcgcgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcatctaaactttagaattaatttattaaatgtattataactttaactttcatcctaatttggtttccttaaaatttttatttatttacaactcaacaaacattgttttgtgtaacatatttaatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaaaccccccaaatt

SEQ ID NO: 565 - DNA, 3496 bp, Homo sapiens
gaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggaaattcagagagatactcatcctacctgaatataaactgagataaatccagtaaagaaagtgtagtaaattctacataagagtctatcattgatttcttttggtggtaaaaatcttagttcatgtgaagaaatttcatgtgaatgttttagctatcaaacagcactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttctaaatgctgaagatgaaaaaagagaggaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttt

SEQ ID NO: 566 - DNA, 1619 bp, Homo sapiens
ccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcctgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttc

SEQ ID NO: 567 - DNA, 1104 bp, Homo sapiens
atgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaatgccatccttctgcatcctcgggcaaactgctgcttccacagtttgggatggtcatcattttaatcagtgtttctgctataaatctctttgttgctctgtag

SEQ ID NO: 568 - DNA, 8239 bp, Homo sapiens
gcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattatcatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaataaaaaaaaaaaaaaaaaaaaaaaaaaaaaaaaaa

SEQ ID NO: 569 - DNA, 897 bp, Homo sapiens
atggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacattgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctag

SEQ ID NO: 570 - DNA, 2032 bp, Homo sapiens
cgcggggcgcggagtcggcggggcctcgcgggacgcgggcagtgcggagaccgcggcgctgaggacgcgggagccgggagcgcacgcgcggggtggagttcagcctactctttcttagatgtgaaaggaaaggaagatcatttcatgccttgttgataaaggttcagacttctgctgattcataaccatttggctctgagctatgacaagagaggaaacaaaaagttaaacttacaagcctgccataagtgagaagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctttcagggagcgacctgggcaaagacagagaagctcccagaaggagagattgatccgtgtctgtttgtaggcggagaaaccgttgggtaacttgttcaagatatgatgcat

SEQ ID NO: 571 - DNA, 3898 bp, Homo sapiens
cgccccccgaccccggatcgaatccccgccctccgcaccctggatatgttttctcccagacctggatatttttttgatatcgtgaaactacgagggaaataatttgggggatttcttcttggctccctgctttccccacagacataccttccgtttggagggccgcggcaccccgtccgaggcgaaggaacccccccatccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaataggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagataggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaccgggcggggtgacaggagagagcgtcagcggcaagctgtggaggatggggctcagaatgcagacctgggctggccgcatggcctctccctgagccctgatttgtggtagggaagcagtatgggtgcagtcccctcctaggcctccctctggggtcccccgatcctatcccacctcttcagggtgagccagcctcacctcttcctagtcctgagggtgagggcaggctgaggcaacgagtgggaggttcaaacaagagtgggctggagccaagggaaaatagagatgatgtaatttctttccggaattc

SEQ ID NO: 572 - DNA, 4859 bp, Homo sapiens
cacgttgggtgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaagccgttctgactggcagggggagaaagtaaacagagttgaatcaccctccccactggccaattggagggggtttggtttgtgacgtgatgggattctgcgaaattgttactgagcaagagaatgccggaacgtgcggaccggccggagcaggggttcagaagccgtcagtggactcgggaaaaagtgtctcttagacctggcgctcggcggggccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgggcgggcgggtcgtcgtccgaggccagggagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggcccttcccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactgggtagattttaaagattcaacactggtgtacatatgtccgctgggtgagttgacctgtggcctcgcacagtgattctaggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatgcgcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagtgttattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacatttacttcccaaaaaagttgttacttgccttttcaagtgtgacaaactcacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctctt

SEQ ID NO: 573 - DNA, 477 bp, Homo sapiens
atgcgacggacaggcgcacccgctcaggctgactctcgggggcgaggtcgagccaggggcggctgccctgggggcgaggcgacgctgtctcaacctccacctcgcggcggaacccgaggagaggagcctcagatgaaagaaacaatcatgaaccaggaaaaactcgccaaactgcaggcacaagtgcgcattggtgggaaagtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccaggaggcttccaagaatga

SEQ ID NO: 574 - DNA, 1552 bp, Homo sapiens
gcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 575 - DNA, 2775 bp, Homo sapiens
gtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaagtctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaa

SEQ ID NO: 576 - DNA, 1185 bp, Homo sapiens
atggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgcgggcagg

SEQ ID NO: 577 - DNA, 1291 bp, Homo sapiens
gctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaaaaaaaaa

SEQ ID NO: 578 - DNA, 1321 bp, Homo sapiens
ggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaccaaaagcacacaacgattatagtaactataagatacaataaaccaaataaatgtgaaagtagattcatgaaaatgtattcctttaaaatattgttttcctacaggcctatttaacaagatgtttcattttctgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgat

SEQ ID NO: 579 - DNA, 900 bp, Homo sapiens
gtgccccgcgctccccgctagcatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaacgtactggtcaacaacgcggccgtcgccttcaagagtgatgatccaatgccctttgacattaaagctgagatgacactgaagacaaatttttttgccactagaaacatgtgcaacgagttactgccgataatgaaacctcatgggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatg

SEQ ID NO: 580 - DNA, 1649 bp, Homo sapiens
cggcagccagcctattctttggccgggtcggtgcgagtggtcggctgggcagagtgcacgctgcttggcgccgcaggtgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattgtattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggtttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgccg

SEQ ID NO: 581 - DNA, 1722 bp, Homo sapiens
gcgggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcaaagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggtttggggtgtggtgggggggtacccttatttcctcgacacgccgctggctcaaagacaatgttattttccttccctttcttgaagaacaaaaagaaagccgggcatgacggctcatgcctgtaatcccagcactttgggaggctgaggcaggtggatcactggaggtcaggtctttgaggccagccctagccaacatggtgtaaacactgtctctactaaaaatacaattagccaggtgtggcggcgtaatcccatgctaacctgtaatcccagctacttgggaggctgaggcagagctgcttgaaccctggaagtggaggttgcagtgagcctgtcatcgctccactgagccaagatcgctcccactgcactccagcctgggcgacagagccagactgtctcaaataaataaatatgagataatgcagtcgggagaagggagggagagaattttattaaatgtgacgaactgcccccccccccccccccagcaggagagcagcaaaatttatgtaaatctttgacggggttttccttgctcctgccaggattaaaagtccatgagtttcttgctcaaaaaaaaaaaaaaaaaaaaaaaaaaaaaaaaa

SEQ ID NO: 582 - DNA, 1686 bp, Homo sapiens
ccacgcgtccgggcgtaagccaggcgtgttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagtctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgtttttttttttaaaa

SEQ ID NO: 583 - DNA, 2103 bp, Homo sapiens
ctctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacgcggaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagccggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggtcacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggtttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacaggaaaaaaaaaaaaaaaaaa

SEQ ID NO: 584 - DNA, 2356 bp, Homo sapiens
gaattcggcacgagcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttatccggggcccaaatcccagcaaagtgctacagcagttgttggtgcttcaacctgaacagcagttaaatatatataaaccctgaagactcatctcattgagaaaggatcctacaacccaccttgaaggtataactggatccagagagggaaggactgacaagaaggaattattcagaaaaacactgacagatgttttataaattgtacagaaaaatagttaaaaatgcaataggttgaagttttccagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcaataatttaaaagagtcaaacactataaatgagtaagttgacgatgttttaagattgcacctggcagtgtgcctttttgcaacaaatatttacctggcagtgtgcctttttgcaacaaatatttactttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaaaa

SEQ ID NO: 585 - DNA, 1789 bp, Homo sapiens
tcgatgctccacgtaggagctggctcggctgccggctgcggtcagggccaccgtataaagagggcggcagacccgagcgcctaggactcgccgctgcccgcgccccgccgccgctgctgcccccagccccggccccaggcgtcccagccatggtccgcccaatgctcttgctcagcctcggcctcctggctggtctgctgccggcgctggccgcctgcccccagaactgccactgccacagcgacctgcagcacgtcatctgcgacaaggtggggctgcagaagatccccaaggtgtcagagaagaccaagctgctcaacctacagcgcaacaacttcccggtgctggctgccaattcgttccgggccatgccgaacctcgtgtcattgcacctgcagcactgccagatccgcgaggtggccgccggtgccttccgcggcctcaagcaacttatctacttgtacctgtcccataacgacatccgcgtcgtgcgtgccggtgccttcgacgacctgaccgagctgacctacctctacctggaccacaacaaggtcactgagctgccccgggggttgctctccccgctggtcaacctcttcatcttgcagctcaacaacaacaagatccgtgagctgcgcgcagggcccttccagggagccaaggacctgcgctggctctacctgtcggaaaacgcgttgagctccctgcagcccggggccctggacgacgtggagaacctcgccaaattccacgtggacaggaaccagctgtccagctacccctcagctgccctgagcaagctacgggtggtggaggagctgaagctgtcccacaaccccctgaaaagcatcccggacaatgccttccagtcctttggcagatacctggagaccctctggctggacaacaccaacctggagaagttctcagatggtgccttcctgggtgtaaccacgctgaaacacgtccatttggagaacaaccgcttgaaccagctaccctcgaacttccccttcgacagcctggagaccctcgcccttaccaataacccctggaagtgtacctgccagctccggggccttcggcggtggctggaagccaaggcctcccgcccagatgccacctgtgcctcacctgccaagttcaagggccagcacatccgtgacacggacgccttccgcagctgcaagttccccaccaagaggtccaagaaagctggccgccattaaacaggttctgacccagccagtcctggtgactggcctctgccttccaccggagagactactgaccttctcacctccgacccataccttctccccacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagaccccccccccccccccaagtcaatcagaaccacaacaggttggtcatcaggatggccaccctcccaggatcatccttcctctgttctctttccctgccacgtggaaacaatcatcagatccttgccccaccccttgcttccagaaagggttttaaagcccatgccccaactctgccagcccccacctgccaggacgttctagcaggtcatcggtgctttgctgtccatcttcccatgctgcaatttcttcctgagatttctataaatataaatgtatgtatgtat

SEQ ID NO: 586 - DNA, 1994 bp, Homo sapiens
gctgccaccgctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaagcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcctctg

SEQ ID NO: 587 - DNA, 1925 bp, Homo sapiens
agtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccattcctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaaccctcggccagcaggtcccctatgccaccaagggcaaccagtgggtaggatacgacgaccaggaaagcgtcaaaagcaaggtgcagtacctgaaggataggcagctggcaggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgatgattaatggaaatgtttacagatccccaagcctggcaagggaatttcttcaactccctgccccctagccctccttatcaaaggacaccattttggcaagctctatcaccaaggagccaaacatcctacaagacacagtgaccatactaattataccccctgcaaagccagcttgaaaccttcacttaggaacgtaatcgtgtcccctatcctacttccccttcctaattccacagctgctcaataaagtacaagagtttaacagtgtgttggcgctttgctttggtctatctttgagcgcccactagacccactggactcacctcccccatctcttctgggttccttcctctgagccttgggacccctgagcttgcagagatgaaggccgccatgtt

SEQ ID NO: 588 - DNA, 1322 bp, Homo sapiens
tagcttggcacgaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgccttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggacccggcgggtgtgcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgagccgattaaaagaccgtgtgaaatg

SEQ ID NO: 589 - DNA, 5701 bp, Homo sapiens
ctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaggcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacac

SEQ ID NO: 590 - DNA, 2156 bp, Homo sapiens
ggcacgagcccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatgggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaaaaaaa

SEQ ID NO: 591 - DNA, 1665 bp, Homo sapiens
gaaggaactggttctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacagg

SEQ ID NO: 592 - DNA, 3748 bp, Homo sapiens
cgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttaygttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttctattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttaccttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatt

SEQ ID NO: 593 - DNA, 1160 bp, Homo sapiens
gcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttcctccgggatcccctgcctggtgcccacactgcctcgcaagcgctcgccaccctcacgtggctcacctgctgttgagccttgtgctgtcaataaacggtttgaggattgc

SEQ ID NO: 594 - DNA, 901 bp, Homo sapiens
gggatctcggactccctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttg

SEQ ID NO: 595 - DNA, 806 bp, Homo sapiens
agcagggggcgctgtgtgtaccgagaatacgagaatacctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgaaaaaaaaaaaaaaaaaaaaaaaa

SEQ ID NO: 596 - DNA, 2368 bp, Homo sapiens
cgggcgatgccgcgctgcgggggggccgcacagccgccgccaccgccaccgccgccgggtggggtgggaggggcgggaacgcgcgccgccgcctccagggtgggcgcctttcgccgtggacgccgaccgtccgggacgagggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaagtattaagtttcacaagctgtttgtactcaaatatattttctcagtttcag

SEQ ID NO: 597 - DNA, 1342 bp, Homo sapiens
cggctgtaatctcagaggcttgtttgctgagggtgcctgcgcacgtgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttcctgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagttt

SEQ ID NO: 598 - DNA, 2434 bp, Homo sapiens
gaattcccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccgtgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttagaaaaaaaaaaaaaaaaaaaaa

SEQ ID NO: 599 - DNA, 2597 bp, Homo sapiens
gagcagcgcgcgcaagcaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaattgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctgggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggctttcaggtgtaggcaggtgggctctgcttcccgattccctgtgagcgcccaccctctcgaaagaattttctgtcttgccctgtgactgtgcagactctggctcgagcaacccggggaacttcaccctcaggggcctctccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaaaaaaaaaaaaaaaa

SEQ ID NO: 600 - DNA, 2422 bp, Homo sapiens
ggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaa

SEQ ID NO: 601 - DNA, 1908 bp, Homo sapiens
gcggaaggaaccgccgggggccatggacggagcagtgatggaagggccgctttttttgcagagtcagcgctttgggaccaagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccgaaaggcagctggactctggcgcctaccgataacccacctaagctttctgccctggagatgctggagaactccttgtacagccctacctgggaaggatcccaattctgggtaacggtgcagaggactgaggccgccgagcgctgtggcctgcatggctcctacgtgctgagggtggaggctgaaaggctgactctcctgaccgtgggggcccagagtcagatactggagccactcctgtcctggccctacactctgttgcgtcgctatggccgggacaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtcaaaaaaaaaaaaaaaaaaa

SEQ ID NO: 602 - DNA, 2361 bp, Homo sapiens
ccccctccgctctgctgcgccgcccggctgggccccgaggccgctccgactgctatgtgaccgcgaggctgcgggaggaaggggacagggaagaagaggctctcccgcgggagcccttgaggaccaagtttgcggccacttctgcaggcgtcccttcttagctctcgcctgcccctttctgcagcctaggcggcccaggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagcgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcggcagaaagttgggactgagcagctgggagcaggcgaccgagctccttccccatcatttctccttggccaacgacgaggccagccagaatggcaataaggactccgaatacataataaaagcaaacagaacactccaacttagagcaataaccggtgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgggtacttgtccctttgttgtcgttgttgtagttaaaggaatttcatttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaa

SEQ ID NO: 603 - DNA, 2303 bp, Homo sapiens
cgcttcccgccgcccgagcttcggaaacttcccggccgcgacgcagggaaccggcgcggagaaccgagcagagcggagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaagcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagataaaaaaaaaaaaaaaaaaa

SEQ ID NO: 604 - DNA, 1230 bp, Homo sapiens
ccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctacggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcgcagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgctttttttgtacggaatagataattaagagtgaaggagttgaaacttttcttgttagtgtacaactcattttgcgccaattttcacaagtgtttgtctttgtctgaatgagaagtgagaag

SEQ ID NO: 605 - DNA, 690 bp, Homo sapiens
cagcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaaccgtattgtttcctttaaaagccaaaa

SEQ ID NO: 606 - DNA, 1755 bp, Homo sapiens
acggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagcttttgcagtcgtgtaatgggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgag

SEQ ID NO: 607 - DNA, 1135 bp, Homo sapiens
ggatccggcaacgaaggtaccatggccggactccggagccgcacaaaccagggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaaaaaaaaaaaaaaaaaaaaaaaaaaaa

SEQ ID NO: 608 - DNA, 662 bp, Homo sapiens
accgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgct

SEQ ID NO: 609 - DNA, 778 bp, Homo sapiens
aagggtcttctgagctgcagtggcaattagaccagaagatccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataaaaatgttcctggtcggggcttggaagagctcttcagtttttctgtttcctcaagtctcagtgctatcctattacaacatggctgatcattaattagaaggttatccttggtgtggaggtggaaaatggtgatttaaaaacttgttactccaagcaacttgcccaattttaatctgaaaatttatcatgttttataatttgaattaaagttttgtccccccccccttttttttataaacaagtgaatacattttataatttcttttggaatgtaaatcaaatttgaataaaaatcttacacgtg

SEQ ID NO: 610 - DNA, 3724 bp, Homo sapiens
  Modified_base 3877, 3350: n = a,c,g, or t
gcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgtgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatgaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggataaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagtcaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttctttttttaaattattattaagacagaatgtgaaggcacaagcaggcttctgagccacttgtcagattgtattcaaagcatcaatccaagaggaggttatgtgtacttcatttattggtgatagttggaagagactgcagactactgctttgaatgagttgaattacataagctaagatcactataaggtccatttcttgaacccacttatacataaaatgtaacccatttagaaaaagattctggatatcatccccccttgaaagatagaaagcattcaggatgtcccagttatcacatgttcacacttgggtttaggggtgtttttttttaaaaccaggcaggttagctagcccaccctgtgctagttttcatgttcacgctgaccctatttgaattaatatcctttgttagagtggtcgagatttcaaacccaattatgtacanggagctgtctgagagctagccagaactggggtacagcctgggctcagggaatagctgtcaacactcgggcaaagtttttgtctgcagcaacgtgtatcaccatttgttttgggatccagtttttgttttaagagagtataaggtgtctcatttgagtctttttcttacctagccccctcttatcagtaaaacaaaggacttgccatggttcacagcaatgtgctacgatccaagatatcaaccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcacttncaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacacttcattcaactttttacaccaaattctgcagagtggtcaaaatggaatattgggggctgttgtaaacagaggcttaattttattagaagtagccagttatttattaaagcatgatgttaataaaataggcatattccaaaaaaaa

SEQ ID NO: 611 - DNA, 1662 bp, Homo sapiens
atgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacaaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcaagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttga

SEQ ID NO: 612 - DNA, 8368 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcgccccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtcaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggtacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatgggggcacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagctgcccctgccctgtgccgtgctgcgctcacctgcctccccagccagccgctgacctctcggctttcacttgggcagagggagccatttggtggcgctgcttgtcttctttggttctgggaggggtgagggatgggg

SEQ ID NO: 613 - DNA, 9432 bp, Homo sapiens
gccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagcgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggggtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcaactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcgccgggggattacgatgttaatatcacatatggaggagcccacatccctggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacatggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagtgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcggctctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggacctgatgtgaaaggaccacgggtgttgtaagctgggaccggaaccaaactggaatcaaacgcgactgtaaattgtatcttataacttattaaataaaacattgctccgtaaaaaaaaaaa

SEQ ID NO: 614 - DNA, 1476 bp, Homo sapiens
acggggcctgggcggsaggggcggtggctggagctcggtaaagctcgtgggaccccattgggggaatttgatccaaggaagcggtgattgccgggggaggagaagctcccagatccttgtgtccacttgcagcgggggaggcggagacgcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaacccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgtta

SEQ ID NO: 615 - DNA, 2400 bp, Homo sapiens
taggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcctaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggtttccctgctcctcctaaacaattggacatgggagatgaagtttacgatgatgtggatacctctgatttccctgtttcatcagcagagatgagtcaaggaactaattttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcatt

SEQ ID NO: 616 - DNA, 3186 bp, Homo sapiens
ggagtctcgcgaggatcttgtgacttatcgcggcatcgcccagcggttgccgggaaacggcgtggcttccgggggcgggcgccctggtcccggagtcgccgctgggcctgtccgctggcgtcatggcaccgaaaaagaaagggaagaaaggcaaagccaaaggcaccccgattgtcgatgggctcgctccagaggacatgagcaaggagcaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgccccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcaatgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctctagtagccctcagtgtcgaaggtgagcttgtaggtgcctgccttcatctggtccaggacagtgaccatctgggtctgtgtagctggggagagaatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgtttt

SEQ ID NO: 617 - DNA, 2225 bp, Homo sapiens
cggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctccccccctaatttattctaatttattaactttgacccaccctttctgagcctgcagccttcccgtgtggcctgagggctgtcgagtgagctgccccagccccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaaaaaaa

SEQ ID NO: 618 - DNA, 2274 bp, Homo sapiens
ggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagaaagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 619 - DNA, 1520 bp, Homo sapiens
ccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgatgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttcc

SEQ ID NO: 620 - DNA, 1670 bp, Homo sapiens
ccaaccacaagcaccaaagcagaggggcaggcagcacaccacccagcagccagagcaccagcccagccatggtccttgaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggaccaaaaaaaaaaaaaaaaaaaaaaaaaaaaaaaaaaaaaaaaaaaaaaa

SEQ ID NO: 621 - DNA, 1103 bp, Homo sapiens
cacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatag

SEQ ID NO: 622 - DNA, 1155 bp, Homo sapiens
aagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacaagacggtgcccatcaatctcataaaggataggggccaacagttttctaaggacttccaggcactgaatcctatgaagcaggtgccaaccctgaagattgatggaatcaccattcaccagtcactggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctct

SEQ ID NO: 623 - DNA, 1985 bp, Homo sapiens
cgccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcatatatttaatgttggagaagattgtccagcgtttgatggactctttgagttttgtcagctctcaactggcggttcagttgctggagctgtgaagttaaaccgacaacagactgatatggctgttaattgggctggaggattacatcatgctaagaaatacgaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgtgtgatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatgggactttttcgtttttgtttttctgggcaagttttattgtgagattttctaattatgaagcaaaatttcttttctccaccatgctttatgtgatagtatttaaaattgatgtgagttattatgtcaaaaaaactgatctattaaagaagtaattggcctttctgagctgaaaaaaaaaaaaaaaaag

SEQ ID NO: 624 - DNA, 1712 bp, Homo sapiens
gccaaattcgggcgaggggcgggcgcggcggagccatgcagtacccgcaccccgggccggcggcgggcgccgtgggggtgccgctgtacgcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctcgtccgccacgaccccctgggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaatagtttatgtactgctcttaggttgttttgataagtgacgattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatcctttttcatttcagagctcttgtctcagagatgtgtgttctttttgtcagagatatggttgatgagaatcttaaatgcttgttttgcactatcacttagtacctgtttgaccaaggtgttaagggatagtacctcccatcagcagagaaactgacctgactaaagttaatcgcagatgaactagaagtcacagttaattaaatgtaagtagatgtagatactgttttatatcaaacaatgtttataatgtgtatatagaattgttcactgtaaaaaaaatggccaaaatgtgttttttttttaataagtaacttgactataaaataaagccgtccgtggccgaattc

SEQ ID NO: 625 - DNA, 3933 bp, Homo sapiens
cacgaggcagcactctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaaaaaaaaaaaaaaaaaaaa

SEQ ID NO: 626 - DNA, 865 bp, Homo sapiens
ctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcctggatgcccacccctgctgccgccactggctgtgcctcccccgccacctgtgtgttcttttgatacatttatcttctgtttttctcaaataaagttcaaagcaaccacctgtaaaaaaaaaaaaaaaaaa

SEQ ID NO: 627 - DNA, 1791 bp, Homo sapiens
cctcgtgccagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagagaaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtacccacttgcagtcaaaatggaattcctcgaaaatgtatttgaaacttggacccccagtgatgccttgatgctgcaacgccttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcttggattaacttagataacttttgtagccagtggttatattgcttataatttaatgtacaatactattgaaactggtgagttctgattattaaatattctctgtaaatcagtaaacatgtataaagt

SEQ ID NO: 628 - DNA, 1321 bp, Homo sapiens
cccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattc

SEQ ID NO: 629 - DNA, 2160 bp, Homo sapiens
agccccctgcccctcgccgccccccgccgcctgcctgggccgggccgaggatgcggcgcagcgcctcggcggccaggcttgctcccctccggcacgcctgctaacttcccccgctacgtccccgttcgcccgccgggccgccccgtctccccgcggcctccgggtccgggtcctccaggacggccaggccgtgccgccgtgtgccctccgccgctcgcccgcgcgccgcgcgctccccgcctgcgcccagcgccccgcgcccgcgccccagtcctcgggcggtccatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagaggcgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacttcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagcccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttcccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttctt

SEQ ID NO: 630 - DNA, 1124 bp, Homo sapiens
gccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaaaaaaaaaaaaaaaa

SEQ ID NO: 631 - DNA, 1887 bp, Homo sapiens
gcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggtaaggagctgggattcgatgcctccgaggtggagttgacgagaaacaatgaattgattgcagttggaaaaggcagctcactgaagcggatccctgtttttggaatggagcctcgcatccgatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacct

SEQ ID NO: 632 - DNA, 3632 bp, Homo sapiens
aaagagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcgaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggccctggggcagaagttaggcacgaggcagtctgggcacttttctgcaagtccactggggctggcccagccaggctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcatagggatgtgaggttctgctgaggaaatgggtatgaatgtgccttgaacacaaagctctgtcaataagtgatacatgttttttattccaataaattgtcaagaccaca

SEQ ID NO: 633 - DNA, 4039 bp, Homo sapiens
tgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcaagcgggccgccaccgcggtggaaactccagctt

SEQ ID NO: 634 - DNA, 1172 bp, Homo sapiens
gagacattcctcaattgcttagacatattctgagcctacagcagaggaacctccagtctcagcaccatgaatcaaactgcgattctgatttgctgccttatctttctgactctaagtggcattcaaggagtacctctctctagaaccgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaatgtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatgatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtactaaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtataagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaataaaaatgaggtactctcctggaaatattaagaaagactatctaaatgttgaaagatcaaaaggttaataaagtaattataact

SEQ ID NO: 635 - DNA, 3583 bp, Homo sapiens
cgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttccctaaaaaaaaaaaaa

SEQ ID NO: 636 - DNA, 3344 bp, Homo sapiens
ggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacaaaatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgc

SEQ ID NO: 637 - DNA, 2682 bp, Homo sapiens
attcctgcgccgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcttttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcatgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccggtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccatgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccgtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatatctgtcatgcactattttcagttgacaatttctgtattttaattgaatactgtttcttcagtcatggttattattgcactttatcctgaataatagttcagaaattgggttttggttcagtgattctcaagaaaaagatctcttgcccattaagaagtgtatcaaaatctcataaggaatgagggagagaagggggctgtacagtttgaaaaagcatattcaatattaaaatagttttatatttgggaaggcaaaaatgaatctattgttttgcaatataggttatacaggaaaatgcaataaaatatatatctggttgt

SEQ ID NO: 638 - DNA, 1288 bp, Homo sapiens
acaccagccctcagtcactgggagaagaacctctcataccctcggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggaaaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctt

SEQ ID NO: 639 - DNA, 639 bp, Homo sapiens
ggacggagggcacgagagaaggagacgctgcagaaagaggcctccagcttggtctgtctcccacctctaccagatctgctgagctatgagccaaaccagggatttacagggaggaaaagctttcggactgctgaaggcccagcaggaagagaggctggatgagatcaacaagcaattcctacacgatcccaaatatagcagtgatgaggatctgccctccaaactggaaggcttcaaagagaaatacatggagtttgaccttaatggaaatggcgatattgatatcatgtccttgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaggaaaaccaacacgccccccagccaagaaagccctatctgagatgcctgatttgagggaaaagggatgatgggattgaaggggttctaatacccagatatggaaacagaagacaaaatcgtaagccagagtcaacaaattaaataaatttaccccaaaaaaaa

SEQ ID NO: 640 - DNA, 2539 bp, Homo sapiens
cgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgatggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatt

SEQ ID NO: 641 - DNA, 1367 bp, Homo sapiens
gaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtg

SEQ ID NO: 642 - DNA, 1940 bp, Homo sapiens
aggcctgctcactcctcagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtatccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagaggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaatgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 643 - DNA, 3414 bp, Homo sapiens
gcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatcgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcaggatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtggatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatagttgagtccttagaaaatgattccagttactcattttgcatattgctatttaacattattggaccctgcatttatagtcctttgatttcttccctctccctggtgtctcccccaagaccccaaataaagcaataccctgttaacactgtgggtttatatactaattctataccccagatggggaattaggggggagatggtccctgggcttaatattctttaaagggcatgggaatttagcctctcttttattgtaatgtgctcttttggaaaatagttggttagcagggagaccagagttgtagattgagattgggtgtactggctgttctgtggaaaacatacattctgtgttcctcgaataagtgaaattgagcttctaatgagatgcacccctttactaacttgatgatgatataaaattcatttttatttagttaattaccagagagatttagcataattttgcttctggattcagtaaatcaagtcagcttggatcattcaccttaacttttcctttagcagccctttccactagtttcccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccgatcggcattcataggatgaaatgaatgactgtcccagaatgagaatttgtccagattattcagataaacatcataaagagaataacattataaataagtagaatatgaataaatagaataataaaattccaaaatactcaatgggaaatgactagtaatataggctttcaagagttggtacctttacgtatatttgcagattctctgggattttaaggaactgagaaaacagaaaagttgactaaattttatatttcttgtcctctaaatattttgataatttctggattgatgcagtgatgtttttcgttccttgtatttataaatgaaaacctttttttggtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggaccttgttgctaaacaatatcccaatagatttgttgacttgaggtctggtttggttttgtttttgttttgttttggttttgttttgtttcccaatagaattaagaattctaatgttgaaaaactgtataaatttttatgggacaaagcctagaaaagagaaatgtagtttgaatcataatctaaatcatcgtatgataggaaggaaaagttttggtgccataatttctcctttcactggtgttggacttaaatcagttgaaatgtatttctgtaccacaatttacgcttcaataaaagtttaattgtctagtgag

SEQ ID NO: 644 - DNA, 3334 bp, Homo sapiens
ctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctggtatattcagggctgtgatgctcgaagtggtatgggactgtatgaagggttggactggctctcacggcaacttgtagctgctggagtattggatgttgcttgattttaaaggcagcagttgtttgaagttttgtggttaaaagtaactttgcacatagtatgttttaagaaattatacatctcaaaagatggtaatttaggatgcatatatatatatatatatataaaggaatcttggattgggaattcagtactttgctttaaaaaaattttgtggcagaattaaatttctaattgagcagattagattgaattaaatagaaacttattgaatatacattcttttaaaaagtatatttgttatttaagtttttcagataatatgtgaccaatatactgggaaagaggtagtcacagagaaagggtaagtgaaggtttattctttcagtgaaaaaagaatagccaattgagtgcctaatgagacctctgtgtgaagcaagtgaagtatagctgcttcttttaacctgccttttcactgaatgttggcagcatttagtagtagaaatgacagttgcttaatgaaatagaatccaaactacatatttggataataggattactttatgtttatgttcagagttaacagaacacctttaatgctaagaactataaggtacagaaaattaatactttatatagtgttttattaactttctcctacagcattttgtataaaacacaatgagggagtgaaatgttacccaattaggcttgtcaggttagtaataaactgaacagtaataaaactgtggaagtaattggatctgaatttatgaaagacccatttccaggactgaacctaggtcagagctctaaattggtccttctatttttcaacaaatttaaagtaatatttctttctaatataatattgcatcctttgtgggaatgactataggtaaaatgtagtaagtaacgcagaaccagggttggctttatttaaaagctagtgacctaaatagaaagcgaacttcaagagaagttgtaagtacagtggcaaatgcttattacttacttcaaactgtttcccaaaataagtgcatttattttgacaataaaacttaaggctgttcatgagaaggccttgaaaagttactctagaggaaaaatgtctaaagaaaaaaaaaattcaaaaagtttacattaattattcagtgttgtgagtaaataaaaatgtgtgctctttactgtttttcatttttaaagaatattattatggaagcacgatttatttaaataggtacattgagacttttttttttaatgttctgatacattaggatgaagttaaatcttaaatcttattagttgaattgttgtaaggacagtgatgtctggtaacaagatgtgactttttggtagcactgttgtggttcattcttttcaaatctatttttgtttaaaaacaatacaagttttagaaaacaaagcattaaaaaaaaagcctatcagtattatgggcaatatgtaaataaataaatgtaatatttcatcctttatttttcaggtaaaaggtcatgctgttacaggtgtagtttgtgtgcataaataatacttccgaattaaattatttaatatttgactgatttcaataactgtgaaaataaaaaggtgttgtattgcttgtgag

SEQ ID NO: 645 - DNA, 1992 bp, Homo sapiens
aaacttcccgcacgcgttacaggagccaggtcggtataagcgccacgcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgatttttttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtttgaaaaaaataaaattcctaaattt

SEQ ID NO: 646 - DNA, 1914 bp, Homo sapiens
gcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttagattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggaacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaaatattccattttcctttccttgtggttgaaaccacagtcagtggagagatgtttggaacacagtcagtggagctggtggtaccaggtttagcattattggatgtcaaaagcattttttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattgtggtaaaa

SEQ ID NO: 647 - DNA, 2015 bp, Homo sapiens
gttttctactttgcccgcccacagatgtagttttctctgcgcgtgtgcgttttccctcctcccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaaggtcccaggggtcttggctgttgccccacgaaacgtgcaggaaccaagatggcggcggcagggcggcggcgcgggcgtgagtcaagggcgggcggtgggcggggcgcggccgctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgacccgtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtaggg

SEQ ID NO: 648 - DNA, 1679 bp, Homo sapiens
atgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagctt

SEQ ID NO: 649 - DNA, 826 bp, Homo sapiens
aattccggaattccccggcctggccagggcggagcggcgcccagtagggacccattcattgtgccggcgcctcactgggcacggggcccaagctgacggcgtgcacgggagcctgcggagcctgggtgggaagaacaggcccctggagggcacttgaccttaagcctcttttcctccgcagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 650 - DNA, 5399 bp, Homo sapiens
gccgcgcgggagagcgggagcctcggccctccgcgcggctgcagctacctaccctgcgcccggccaggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggcccgaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgaggtgatgcacacccggaaacggcattcagaactctaccacgagctcaaccagaagttccacactttcgaccgctaccgcagccagtccacggccaagagggagaagcggtggagtgtgtcctcgggtggggcggccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgg

SEQ ID NO: 651 - DNA, 2388 bp, Homo sapiens
tcctgccccaggcccagcttctctcctgccttccaacgccatggggagcaatctcagcccccaactctgcctgatgccctttatcttgggcctcttgtctggaggtgtgaccaccactccatggtctttggcccagccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaac

SEQ ID NO: 652 - DNA, 1813 bp, Homo sapiens
caggccttgaggttttggcagctctggaggatgagagagaacatggccaggggcccttgcaacgcgccgagatgggtgtccctgatggtgctcgtcgccataggcaccgccgtgacagcggccgtcaaccctggcgtcgtggtcaggatctcccagaagggcctggactacgccagccagcaggggacggccgctctgcagaaggagctgaagaggatcaagattcctgactactcagacagctttaagatcaagcatcttgggaaggggcattatagcttctacagcatggacatccgtgaattccagcttcccagttcccagataagcatggtgcccaatgtgggccttaagttctccatcagcaacgccaatatcaagatcagcgggaaatggaaggcacaaaagagattcttaaaaatgagcggcaattttgacctgagcatagaaggcatgtccatttcggctgatctgaagctgggcagtaaccccacgtcaggcaagcccaccatcacctgctccagctgcagcagccacatcaacagtgtccacgtgcacatctcaaagagcaaagtcgggtggctgatccaactcttccacaaaaaaattgagtctgcgcttcgaaacaagatgaacagccaggtctgcgagaaagtgaccaattctgtatcctccaagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatgcacacaactggttccatggaggtcagcgccgagtccaacaggcttgttggagagctcaagctggataggctgctcctggaactgaagcactcaaatattggccccttcccggttgaattgctgcaggatatcatgaactacattgtacccattcttgtgctgcccagggttaacgagaaactacagaaaggcttccctctcccgacgccggccagagtccagctctacaacgtagtgcttcagcctcaccagaacttcctgctgttcggtgcagacgttgtctataaatgaaggcaccaggggtgccgggggctgtcagccgcacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtg

SEQ ID NO: 653 - DNA, 3359 bp, Homo sapiens
ggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatctcatgacaggcagccagtctcaacatgggtaaggggtgggggtgaaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttaggggtcgttttcacatatgacaatgttgcatttatgatgcagttttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaagaaaaaaaaaaaaaaaaaa

SEQ ID NO: 654 - DNA, 2386 bp, Homo sapiens
tgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaattaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaaccaaagggcccctttctttcttctgaggattgcagaggatatag

SEQ ID NO: 655 - DNA, 2647 bp, Homo sapiens
gggccggagttcctgcagagggagcgtcaaggccctgtgctgctgtccctgggggccagaggggttgcccagcatgcccactggcaggagagagggaactgacccacttgctcctaccagcttctgaaggctccaaagtccggagtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagc

SEQ ID NO: 656 - DNA, 1453 bp, Homo sapiens
agcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatcaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 657 - DNA, 1350 bp, Homo sapiens
cgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttgtccatatttgctccatttcttactttacaacttgcgtacatgggattatacaaatattttcccaagagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacgaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttcgggagctgagctagtgcttttaggagaacagataaatgtggtctcagccagccctagagactgcttcttgtgtttgtgtcattctgtcctgagaaatgaagtcatctgaaaaataaaaatgcagaaacccaa

SEQ ID NO: 658 - DNA, 1221 bp, Homo sapiens
cgcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccctttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttccc

SEQ ID NO: 659 - DNA, 1476 bp, Homo sapiens
actgtacacatgctagggtccaggacagcaggaccaagccagcagaaacagcctcagcctaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgactatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggcacatggacacagccctttgacctggcaagcaccagggaggagaacttctatgtggacgagacaactgtggtgaaggtgcccatgatgttgcagtcgagcaccatcagttaccttcatgactcagagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgaccttggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctg

SEQ ID NO: 660 - DNA, 1209 bp, Homo sapiens
cagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtg

SEQ ID NO: 661 - DNA, 1325 bp, Homo sapiens
gcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacggctccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgcctcttgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccagactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgaggggcccaggcaggcgggcgccaccgccacccgcagcgagggcggagccggccccaggtgctccacatgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaaaaaaaaaaaaaaaaaaaaaaaaaaaaaaaaaaaaaaaaaaaaaaaaaaaaaaaaaaaaa

SEQ ID NO: 662 - DNA, 2010 bp, Homo sapiens
cgagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaggccacgaagg

SEQ ID NO: 663 - DNA, 1504 bp, Homo sapiens
cctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaacaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgac

SEQ ID NO: 664 - DNA, 1922 bp, Homo sapiens
ggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtgtgtgtgtgtatacatgccagtgacacttccagtcccctttgtattccttaaataaactcaatgagctcttccaaaaaaaaaaa

SEQ ID NO: 665 - DNA, 1285 bp, Homo sapiens
gggctgcctgtgacgcgcggcgcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttctgtttaagcaccatggccttgatgattcactgttggggagaagaaacaagaaaagtaactggttgtcacctatgagacccttacgtgattgttagttaagtttttattcaaagcagctgtaatttagttaataaaataattatgatc

SEQ ID NO: 666 - DNA, 933 bp, Homo sapiens
aactgtctcctgcgttgctgggaagttctggaaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagaatgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcagcaggacagagactgtataggctgaccagaagcatgctgctgaattatcaacgaggattttcaagttaacttttaaatactggttattatttaat

SEQ ID NO: 667 - DNA, 1702 bp, Homo sapiens
agactcaacaagagctccagcaaagactttcactgtagcttgacttgacctgagattaactagggaatcttgagaataaagatgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatgaactttctaaaacgatacgcaggtagagaggaacactgggttggactgaaaaaggaacctggtcacccatggaagtggtcaaatggcaaagaatttaacaactggttcaacgttacagggtctgacaagtgtgtttttctgaaaaacacagaggtcagcagcatggaatgtgagaagaatttatactggatatgtaacaaaccttacaaataataaggaaacatgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactactggaaggagttagatgttggtactagatactgaatgtaaacaaaggaattatggctggtaacataggtttttagtctaattgaatcccttaaactcagggagcatttataaatggacaaatgcttatgaaactaagatttgtaatatttctctctttttagagaaatttgccaatttactttgttatttttccccaaaaagaatgggatgatcgtgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaaaaaaaaaaaaaaaaaaaaaaaaaaaa

SEQ ID NO: 668 - DNA, 1050 bp, Homo sapiens
ggggggggggggcacttggcttcaaagctggctcttggaaattgagcggagacgagcggcttgttgtagctgccgtgcggccgccgcggaataataagccgggatctaccataccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatg

SEQ ID NO: 669 - DNA, 3171 bp, Homo sapiens
gcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccacgtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaaaggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctaggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaa

SEQ ID NO: 670 - DNA, 2625 bp, Homo sapiens
cggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagaggctataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccgaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagcccaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaacaggtatttttt

SEQ ID NO: 671 - DNA, 430 bp, Homo sapiens
gacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggagaataaagttacccttgtactgca

SEQ ID NO: 672 - DNA, 1001 bp, Homo sapiens
gccgcggctgcggaacgggcggaggctgccggtttcgtaaccgtcgctcctcctcgctgactcgcgggctgtgaggcctgggtcggctcgggccgcaccgcgcggggccgctcggagtggaggccgcctgggggcaggcgggctagaggagcaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggtaaaaaaagaaatatctgggatcccgatgttcttaataaatcctgacttccc

SEQ ID NO: 673 - DNA, 1389 bp, Homo sapiens
cgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcaagagaaatatgtgttaaattcactcgtggtgtggacttcaattggcaagcccaggccctattggccctacaagaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggttatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatga

SEQ ID NO: 674 - DNA, 1838 bp, Homo sapiens
aattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgc

SEQ ID NO: 675 - DNA, 717 bp, Homo sapiens
agagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttctgccgggtgttgtatgtgtggtgacttgcggatttatgtttcagtgtactggaaactttccattttattcaagaaatctgttcatgttaaaagccttgattaaagaggaagtttttataat

SEQ ID NO: 676 - DNA, 627 bp, Homo sapiens
agtctccggcgagttgttgcctgggctggacgtggttttgtctgctgcgcccgctcttcgcgctctcgtttcattttctgcagcgcgccacgaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttaaaaaaaaaaaaaaa

SEQ ID NO: 677 - DNA, 4562 bp, Homo sapiens
ccgagaggcaaatgagcttgtcagtttctgcctccattagaccctcaacccaaaggagcaggagatttcggtagcgttttaactttatctcagaatctgaaagcggaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatcgctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggtactacttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaataacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagccaatttgggcactgggcatctttgtatttgaacttaacgacacatttactcttttagtcaggatttcggtcttttctgcgggaaggaattaagctatgtattaggtccaccatacgatctgtgtaagtaagattatcccacttgccctttctctttagtctttgtcccttccttttcactaagtgcccctcatccttttcaatctcattgtcactggatagtgctgtatcacttaggtgtgcattcggctgcaaataacagaaaacccagcaaacactgaagggctggataagaaccctgagagggggtactccaggactgtctccataacatcattgggatccccatcccgttgctatttctttttcaccgtttttaccttttgtcctctggcttattgcctcagagttgcaagatggttcctgaactgtcaggtatcatgtctgctttctaagtgggaagaggaagggagaggcaagcaactaggtacaatgtctatcaggaaagcaaagcttccccagagacgctcagcttgtatccattgactggaagtctgtcacgtggctccccctagccgcacactagtgtgggaaggaaaatattgagctaggcacattactctctgaacgaaattcatattatcttattaaggaagagtgttggtcttcaggaggggaagtttgctgtattggatgccatcatcg

SEQ ID NO: 678 - DNA, 2139 bp, Homo sapiens
gtgagacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagccctgctccagaagttagcttcaccccaatcccagctacctcaaccaatgccgaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggccacgagcttgttctttgttctttgtcacagggactgaaaacctctcctcatgttctgctttcgattcgttaagagagcaacattttacccacacacagataaagttttcccttgaggaaacaacagctttaaaag

SEQ ID NO: 679 - DNA, 1607 bp, Homo sapiens
gctctgtagcacccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaataggttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaactttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgaaaaaaa

SEQ ID NO: 680 - DNA, 5010 bp, Homo sapiens
atggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccccgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccaggactgcgtggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggacaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataa

SEQ ID NO: 681 - DNA, 2480 bp, Homo sapiens
atggccgggccgcgcgcgtgcgcgccgctcctgctcctgctcctcctcgggcagcttctggcggccgccggggcgcagagagtgggactccccggcccccccggccccccagggcgccctgggaagcccggccaggacggcattgacggagaagctggtcctccaggtctgcctggtcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggacctcctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccaggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgaaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcgggggtgtggcaggcgggtgacgtccaggagagggagcgcccctggctgcccctcggccgccgactggacgcgtgggccttgccagcgagcaccctcattgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttgcatagcatttgtgtaaagactatgatctcatcccaataaaatgatatattaaatcttcagattaatgactggctacagagtaacaaaaaataaacaatttaatgtacagtaaattctctccca

SEQ ID NO: 682 - DNA, 1804 bp, Homo sapiens
gcggtggtggacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacagtgctgcacatcatccaggtggtcataagctacttcctcatgctcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagccatgaacttgccaatcaaaaaatgacaatcaatttgagaaaatagaaatagatatttttaaataaaaccattcacagttt

SEQ ID NO: 683 - DNA, 799 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctg

SEQ ID NO: 684 - DNA, 2443 bp, Homo sapiens
aaatggcgtgcccgtctctccgccggccccctgcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatccccagtgaaaaaaaa

SEQ ID NO: 685 - DNA, 2085 bp, Homo sapiens
gcatttcttccttctgcgtatgggacaggaccctttctggaatgggggtcttatgacctacaatcaaacaagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatattataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaatgcctgcaaaaagaagatcattttgtatacagagaaccggatgaatataagcaatgaagatgaacatttattgatcttctacatacaagacttcaccataaggccaggagcagtgctcacgccttgtaatcccagcactttgggaggccaaggtgggcggatcaccttgaggtcaggagttcaagaccagcctgaccaacatggtgaaaccctgtctctactaaatattagcggggtgtggtggcgggcacctgtagtcgcagcctttcgggaggctgagacaggagaatcgcttgaaccctagaggcggagtttgcagtgagccgagatagtgccattgtactccagcttgggcaacagagtaagactctgtctc

SEQ ID NO: 686 - DNA, 691 bp, Homo sapiens
gacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaac

SEQ ID NO: 687 - DNA, 1238 bp, Homo sapiens
agactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccacggtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcagtg

SEQ ID NO: 688 - DNA, 1259 bp, Homo sapiens
ccgcctccgtgttccgtttcctgccgccctcctctcgtagccttgcctagtgtggagccccaggcctccgtcctcttcccagaggtgtcgaggcttggccccagcctccatcttcgtctctcaggatggcgagtagcagcggctccaaggctgaattcattgtcggtgggaaatataaactggtacggaagatcgggtctggctccttcggggacatctatttggcgatcaacatcaccaacggcgaggaagtggcactgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttcaagtgggcagggtcagcaggcccaaacccccacaggcaagcaaactgacaaatccaagagtaacatgaaaggtttctaatttctaagcatgaattgaggaacagaagaagcagacgagatgatcggagcagcatttgtttctccccaaatctagaaattttagttcatatgtacactagccagtggttgtggacaacca

SEQ ID NO: 689 - DNA, 7918 bp, Homo sapiens
  Modified_base 7434: n = a,c,g, or t
atgcagtccggccgcggccccccacttccagcccccggcctggccttggctttgaccctgactatgttggccagacttgcatccgcggcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctagagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggccattatgaagctttctccaccctggctcccgaggcttggccagccatggagctgcctgagccatgcgtgcctgagccagggctgcctcctgtctttgccaatttcacccagctgctgactatcagcccactggtggtggccgagggtggcacagcctggcttgagtggaggcatgtgcagcccacgctggacctgatggaggctgagctgcgcaaatcccaggtgctgttcagcgtgacccgaggggcacactatggcgagctcgagctggacatcctgggtgcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccactgcggtggtcctgcacaggacttgacgttccgggtcagcgatggactgcaggccagccccccggccacgctgaaggtggtggccatccggccggccatacagatccaccgcagcacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcatagtacaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagctcgtgcctcagaggcagtcgaggacaccttccgtttccgtgtcacagctccaccatatttctccccactctataccttccccatccacattggtggtgacccagatgcgcctgtcctcaccaatgtcctcctcgtggtgcctgagggtggtgagggtgtcctctctgctgaccacctctttgtcaagagtctcaacagtgccagctacctctatgaggtcatggagcggccccgccttgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacaactagtccgggctggtcagccagccacagccttctcccagcaggacctgctggatggggccgttctctatagccacaatggcagcctcagccccgaagacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggacccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccagctggacggcgggctcgtgctgttctcacacagaggaaccctggatggaggcttcccgttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaaggcctggcctgggcccagatgctgatcgggccagggacaggcttgcccatgtcccgggccccattgcttccatgcccggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttctactccaacccaggccaccctttgtctctnccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggctaggctggggctcatcgagggtctcaggccgaggccactgtagtgccagtgcccccctgaggactagggcaggcagctgggggcacttggttccatggagcctggataaacagtgctttggaggctctggaaaaaaaaaaaaaaaaaaaaaa

SEQ ID NO: 690 - DNA, 736 bp, Homo sapiens
ggctctcaccctcctctcctgcagctccagctctgtgctctgcctctgaggagaccatggcccggcctctgtgtaccctgctactcctgatggctaccctggctggggctctggcctcgagctccaaggaggagaataggataatcccaggtggcatctatgatgcagacctcaatgatgagtgggtacagcgtgcccttcacttcgccatcagcgagtacaacaaggccaccgaagatgagtactacagacgcccgctgcaggtgctgcgagccagggagcagacctttgggggggtgaattacttcttcgacgtagaggtgggccgcaccatatgtaccaagtcccagcccaacttggacacctgtgccttccatgaacagccagaactgcagaagaaacagttatgctctttcgagatctacgaagttccctgggaggacagaatgtccctggtgaattccaggtgtcaagaagcctaggggtctgtgccaggccagtcacaccgaccaccacccactcccaccccctgtagtgctcccacccctggactggtggcccccaccctgcgggaggcctccccatgtgcctgtgccaagagacagacagagaaggctgcaggagtcctttgttgctcagcagggcgctctgccctccctccttccttcttgcttctaatagacctggtacatggtacacacacccccacctcctgcaattaaacagtagcatcgcc

SEQ ID NO: 691 - DNA, 2758 bp, Homo sapiens
ctatccgcgcgcgtcgccggcccagtcctgtcgctgacgggaggatctgaagccggccgcaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtggcgaaatacaccgagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagatgtccccatcggtcaccttgtttctcaactacctcgcatcattgcagatcgtagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtgcgtgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaagggcaatatgaagttactttcttaatgtgacctagcaataggcatagctacgtggcactatattctggccagactcgatgtgtactctaacttaagaaataaatcagtaaggcag

SEQ ID NO: 692 - DNA, 1575 bp, Homo sapiens
agaaccgcgacctccgcaaccttgagcggcatccgtggagtgcgcctgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgt

SEQ ID NO: 693 - DNA, 716 bp, Homo sapiens
atggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccagaaccttaaaggcggtgtttcaaggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagt

SEQ ID NO: 694 - DNA, 1017 bp, Homo sapiens
cggtcaagatggcgctggtggcttctgtgcgagtcccggcgcgcgttctgctccgcgcgggggcccggctcccgggcgcggccctcgggcggacggagcgggcggccggcggcggagacggcgcgcggccgttcgggagccagcgggtgctggtggagccggacgcggccgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaaaaaaaaaaaaaaaaaa

SEQ ID NO: 695 - DNA, 5879 bp, Homo sapiens
ggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgatggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagccagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtaaccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcataaagtaatatttacagatgtggggagatgtaataaaacaatattaacttggaaaaaaaaaaaaaaaaaaa

SEQ ID NO: 696 - DNA, 3516 bp, Homo sapiens
tcgagggtgcgatggcgcggacgcgggaccgcgtacgcctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaatgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgaggttctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaagcgtttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacgctagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaagga

SEQ ID NO: 697 - DNA, 3336 bp, Homo sapiens
ttttcttagacattaactgcagacggctggcaggatagaagcagcggctcacttggactttttcaccagggaaatcagagacaatgatggggctcttccccagaactacaggggctctggccatcttcgtggtggtcatattggttcatggagaattgcgaatagagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaagattacttcagattaccaagcaacccagaaaatcacctaccgaatctctggagtgggaatcgatcagccgccttttggaatctttgttgttgacaaaaacactggagatattaacataacagctatagtcgaccgggaggaaactccaagcttcctgatcacatgtcgggctctaaatgcccaaggactagatgtagagaaaccacttatactaacggttaaaattttggatattaatgataatcctccagtattttcacaacaaattttcatgggtgaaattgaagaaaatagtgcctcaaactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagagcaagctagcagctatcgtctggttgtgagtggtgcagacaaagatggagaaggactatcaactcaatgtgaatgtaatattaaagtgaaagatgtcaacgataacttcccaatgtttagagactctcagtattcagcacgtattgaagaaaatattttaagttctgaattacttcgatttcaagtaacagatttggatgaagagtacacagataattggcttgcagtatatttctttacctctgggaatgaaggaaattggtttgaaatacaaactgatcctagaactaatgaaggcatcctgaaagtggtgaaggctctagattatgaacaactacaaagcgtgaaacttagtattgctgtcaaaaacaaagctgaatttcaccaatcagttatctctcgataccgagttcagtcaaccccagtcacaattcaggtaataaatgtaagagaaggaattgcattccgtcctgcttccaagacatttactgtgcaaaaaggcataagtagcaaaaaattggtggattatatcctgggaacatatcaagccatcgatgaggacactaacaaagctgcctcaaatgtcaaatatgtcatgggacgtaacgatggtggatacctaatgattgattcaaaaactgctgaaatcaaatttgtcaaaaatatgaaccgagattctactttcatagttaacaaaacaatcacagctgaggttctggccatagatgaatacacgggtaaaacttctacaggcacggtatatgttagagtacccgatttcaatgacaattgtccaacagctgtcctcgaaaaagatgcagtttgcagttcttcaccttccgtggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagtcagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccgcctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgc

SEQ ID NO: 698 - DNA, 2390 bp, Homo sapiens
ccagcctcggagggagggattagaagccgctagactttttttcctcccctctcagtagcacggagtccgaattaattggatttcattcactggggaggaacaaaaactatctgggcagcttcattgagagagattcattgacactaagagccagcgctgcagctggtgcagagagaacctccggctttgacttctgtctcgtctgccccaaggccgctagcctcggcttgggaaggcgaggcggaattaaaccccgctccgagagcgcacgttcgcgcgcggtgcgtcggccattgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaagtgaagactaattcaattttgcatatagaggagccaaagagagatttcagctctgtatttgtggtatcagtgttggaaaagagaaatctgatactccatttggattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctctgttgtaatccaaaggggagatttgcagcatgcttgactttaccaattctgatgacatctttacggacactattatcactaagaccttgttatggcgaagtctttagtctttttcatgtattttcctcatgattttttctctttatgtagtttgagtatgccttacctttgtaaatatttttgcttgtgttgtcgcaaaggggataatctgggaaagacaccaaatcatgggctcactttaaaa

SEQ ID NO: 699 - DNA, 1600 bp, Homo sapiens
gccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 700 - DNA, 3838 bp, Homo sapiens
ggcttaggaagtattaactgatctctgccctagttctcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcgctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaaaaaaaaaa

SEQ ID NO: 701 - DNA, 1251 bp, Homo sapiens
ggagctgtttacccccactctaataggggttcaatataaaaagccggcagagagctgtccaagtcagacgcgcctctgcatctgcgccaggcgaacgggtcctgcgcctcctgcagtcccagctctccaccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagacttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattc

SEQ ID NO: 702 - DNA, 1240 bp, Homo sapiens
ccagcttaatagcaggacgctggcaacaggcactccctgctccagtccagcctggcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgaacagacagctccttacggcctgggaaacccgccaagacgccggcgccgctccctgccaaggcgctgtcagtgctccagtgccagggaccccgcctgtgccaccttctgccttcgaaggccctggactgaagccggggcagtcccaagccggaagtcccctgcagacgtgttccagactggcaagacaggggccactacaggagagcttctccaaaggctgagggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggagactggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacat

SEQ ID NO: 703 - DNA, 1755 bp, Homo sapiens
cctcggctccggaatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggcgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggaaaagaagagcggcggcgccggcaaggtcaccaagtcggcgcagaaggcgcagaaggcgggcaagtgaagcgcgggccgcggcgcgaccctccccggcggcgccgcgctccgaaccccggcccggcccccgccccgcccccgccccgcgcgccgctccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccag

SEQ ID NO: 704 - DNA, 991 bp, Homo sapiens
gggatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtgcgaggtgcctcccgccaggagaacggcgccacggtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgagggccctgccacgattaaagactgagaccggcaaaaaaaaaaa

SEQ ID NO: 705 - DNA, 3075 bp, Homo sapiens
atggttaattttacggtggatcagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcatatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcactcagctgtactagtgccattggaataataaatttgataaggtgtgaaaa

SEQ ID NO: 706 - DNA, 558 bp, Homo sapiens
gaattccgtccgctcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcag

SEQ ID NO: 707 - DNA, 2100 bp, Homo sapiens
ggcacgagctctctctctctctctctctctctctcgccgccatgacgctgcgcggcgccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctggcctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtagtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgac

SEQ ID NO: 708 - DNA, 4975 bp, Homo sapiens
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggggggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggggtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtagaagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctc

SEQ ID NO: 709 - DNA, 852 bp, Homo sapiens
caccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatcaaaaaaaaaaaaaaaaa

SEQ ID NO: 710 - DNA, 2957 bp, Homo sapiens
gaattcccaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttcttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagcggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaattttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaaataaataattaaaaattaagaataaataaacgagttgacctcggtcacaaaagcagttttactatcgaatcaatcgctgttatttttttttaatgtaatttgtacatcttttttcaatctgtacatttgggctgtcttgtatgtttttatgctcctttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcaaaaaaaaaaaaa

SEQ ID NO: 711 - DNA, 7680 bp, Homo sapiens
gcggacactcctctcggctcctccccggcagcggcggcggctcggagcgggctccggggctcgggtgcagcggccagcgggcctggcggcgaggattacccggggaagtggttgtctcctggctggagccgcgagacgggcgctcagggcgcggggccggcggcggcgaacgagaggacggactctggcggccgggtcgttggccgggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctccttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcccgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccaggggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagacctttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagagttttctccatatcaaaacgagggctgatggaggaaaaaggtcaataaggtcaagggaagaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttgttcctcttctttacacatacgcaaaccacctgtgacagctggcaattttataaatcaggtaactggaaggaggttaaactcagaaaaaagaagacctcagtcaattctctacttttttttttttttttccaaatcagataatagcccagcaaatagtgataacaaataaaaccttagctgttcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtgtgtgtgtgtgtgtgtgtgtgtgtgtgtgtgtgtgtgtgggtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataatatacttaaaaatatttcttaattgggatttgtaatcgtaccaacttaattgataaacttggcaactgcttttatgttctgtctccttccataaatttttcaaaatactaattcaacaaagaaaaagctcttttttttcctaaaataaactcaaatttatccttgtttagagcagagaaaaattaagaaaaactttgaaatggtctcaaaaaattgctaaatattttcaatggaaaactaaatgttagtttagctgattgtatggggttttcgaacctttcactttttgtttgttttacctatttcacaactgtgtaaattgccaataattcctgtccatgaaaatgcaaattatccagtgtagatatatttgaccatcaccctatggatattggctagttttgcctttattaagcaaattcatttcagcctgaatgtctgcctatatattctctgctctttgtattctcctttgaacccgttaaaacatcctgtggcactc

SEQ ID NO: 712 - DNA, 2863 bp, Homo sapiens
cggaattcaagaaacacaaaatgcagtgggcgtccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttcctcacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacgatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtcgtgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttatggaagatctgggacagaccgtgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcc

SEQ ID NO: 713 - DNA, 2861 bp, Homo sapiens
ctgctcctgcgcggcagctgctttagaaggtctcgagcctcctgtaccttcccagggatgaaccgggccttccctctggaaggcgagggttcgggccacagtgagcgagggccagggcggtgggcgcgcgcagagggaaaccggatcagttgagagagaatcaagagtagcggatgaggcgcttgtggggcgcggcccggaagccctcgggcgcgggctgggagaaggagtgggcggaggcgccgcaggaggctcccggggcctggtcgggccggctgggccccgggcgcagtggaagaaagggacgggcggtgcccggttgggcgtcctggccagctcaccttgccctggcggctcgccccgcccggcacttgggaggagcagggcagggcccgcggcctttgcattctgggaccgcccccttccattcccgggccagcggcgagcggcagcgacggctggagccgcagctacagcatgagagccggtgccgctcctccacgcctgcggacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggagtaagttcttcaaacacccatttttgctctatgggaaaaaaacgatttaccaattaatattactcagcacagagatgggggcccggtttccatattttttgcacagctagcaattgggctccctttgctgctgatgggcatcattgtttaggggtgaaggagggggttcttcctcaccttgtaaccagtgcagaaatgaaatagcttagcggcaagaagccgttgaggcggtttcctgaatttccccatctgccacaggccatatttgtggcccgtgcagcttccaaatctcatacacaactgttcccgattcacgtttttctggaccaaggtgaagcaaatttgtggttgtagaaggagccttgttggtggagagtggaaggactgtggctgcaggtgggactttgttgtttggattcctcacagccttggctcctgagaaaggtgaggagggcagtccaagaggggccgctgacttctttcacaagtactatctgttcccctgtcctgtgaatggaagcaaagtgctggattgtccttggaggaaacttaagatgaatacatgcgtgtacctcactttacataagaaatgtattcctgaaaagctgcatttaaatcaagtcccaaattcattgacttaggggagttcagtatttaatgaaaccctatggagaatttatccctttacaatgtgaatagtcatctcctaatttgtttcttctgtctttatgtttttctataacctggattttttaaatcatattaaaattacagatgtgaaaataaagcagaagcaacctttttccctcttcccagaaaaccagtctgtgtttacagacagaagagaaggaagccatagtgtcacttccacacaattatttatttcatgtctttactggacctgaaatttaaactgcaatgccagtcctgcaggagtgctggcattaccctctgcagaacagtgaaaggtattgcactacattatggaatcatgcaaaaaaaa

SEQ ID NO: 714 - DNA, 1283 bp, Homo sapiens
ctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 715 - DNA, 2742 bp, Homo sapiens
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagtacgcgcgccgcgtcgtttacgcggcgatttcatcatgctccgagccggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctcctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaactactcttatgtccactttacaaaagaaaacagcattgtgattactcccagggaccgtattttatcttcagtggctgcctgattttacccccacaattaaagttgaaggaatcctga

SEQ ID NO: 716 - DNA, 2365 bp, Homo sapiens
tcccagccttcccatccccccaccgaaagcaaatcattcaacgacccccgaccctccgacggcaggagccccccgacctcccaggcggaccgcccttccctccccgcgcgggttccgggcccggcgagagggcgcgacgacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaaatcctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggccctctgcaaaggaaataccagttctgggcaatcagtgttaccgttcaccagttgccattgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaattttcggttgaataaactagattacattcagttggcaaaaaaaaaaaaa

SEQ ID NO: 717 - DNA, 2881 bp, Homo sapiens
acagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttccgagtttccccagaagagaatatgggattttttttgacatttttgacccatttaataatgctcttgtgtttacctagtatatgtagactttgtcttatgtgtcaaaagtcctaggaaagtggttgatgtttcttatagcaattaaaaattatttttgaactga

SEQ ID NO: 718 - DNA, 1610 bp, Homo sapiens
ggcacgaggctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtgggcggccgcctgcctgcccgcccgcccgcagccccttgcctgccggcccctgggcggcccgtgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatac

SEQ ID NO: 719 - DNA, 1366 bp, Homo sapiens
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctggtggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgttttttttcattcc

SEQ ID NO: 720 - DNA, 2060 bp, Homo sapiens
tgttcccagcactcaagccttgccaccgccgagccgggcttcctgggtgtttcaggcaaggaagtctaggtccctggggggtgacccccaaggaaaaggcagcctccctgcgcacccggttgcccggagccctctccagggccggctgggctgggggttgccctggccagcaggggcccgggggcgatgccacccggtgccgactgaggccaccgcaccatggcccgctcgctgacctggcgctgctgcccctggtgcctgacggaggatgagaaggccgccgcccgggtggaccaggagatcaacaggatcctcttggagcagaagaagcaggaccgcggggagctgaagctgctgcttttgggcccaggcgagagcgggaagagcaccttcatcaagcagatgcggatcatccacggcgccggctactcggaggaggagcgcaagggcttccggcccctggtctaccagaacatcttcgtgtccatgcgggccatgatcgaggccatggagcggctgcagattccattcagcaggcccgagagcaagcaccacgctagcctggtcatgagccaggacccctataaagtgaccacgtttgagaagcgctacgctgcggccatgcagtggctgtggagggatgccggcatccgggcctgctatgagcgtcggcgggaattccacctgctcgattcagccgtgtactacctgtcccacctggagcgcatcaccgaggagggctacgtccccacagctcaggacgtgctccgcagccgcatgcccaccactggcatcaacgagtactgcttctccgtgcagaaaaccaacctgcggatcgtggacgtcgggggccagaagtcagagcgtaagaaatggatccattgtttcgagaacgtgatcgccctcatctacctggcctcactgagtgaatacgaccagtgcctggaggagaacaaccaggagaaccgcatgaaggagagcctcgcattgtttgggactatcctggaactaccctggttcaaaagcacatccgtcatcctctttctcaacaaaaccgacatcctggaggagaaaatccccacctcccacctggctacctatttccccagtttccagggccctaagcaggatgctgaggcagccaagaggttcatcctggacatgtacacgaggatgtacaccgggtgcgtggacggccccgagggcagcaagaagggcgcacgatcccgacgccttttcagccactacacatgtgccacagacacacagaacatccgcaaggtcttcaaggacgtgcgggactcggtgctcgcccgctacctggacgagatcaacctgctgtgacccaggccccacctggggcaggcggcaccggcgggcgggtgggaggtgggagtggctgcagggaccctagtgtcctggtctatctctccagcctcggcccacacgcaagggagtcgggggacggcccgctgctggccgctctcttctctgcctctcaccaggacagccgccccccagggtactcctgcccttgcttgactcagtttccctcctttgaaagggaaggagcaaaacggccatttgggatgccagggtggatgaaaaggtgaagaaatcaggggattgagacttgggtgggtgggcatctctcaggagccccatctccgggcgtgtcacctcctgggcagggttctgggaccctctgtgggtgacgcacaccctgggatggggctagtagagccttcaggcgccttcgggcgtggactctggcgcactctagtggacaggagaaggaacgccttccaggaacctgtggactaggggtgcagggacttccctttgcaaggggtaacagaccgctggaaaacactgtcactttcagagctcggtggctcacagcgtgtcctgccccggtttgcggacgagagaaatcgcggcccacaagcatcccccatcccttgcaggctgggggctgggcatgctgcatcttaaccttttgtatttattccctcaccttctgcagggctccgtgcgggctgaaattaaagatttcttag

SEQ ID NO: 721 - DNA, 2679 bp, Homo sapiens
gagaccaggaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacaagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcacctggaggagggccggctcgctgcccgagctctggcctagggaccttgccgctgaccaagagggaggaccagtgcagggtctgtgcaccttccctgctggcctgcacacagctgctcagcaccatttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctggcatttttttttgttttttgttttttggttttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgctttgtttttatttaagaaaataaacacgacatatttaaagaaggttctttcacctgggagcaaatgaacaatagctaagtgtcttggtatttaaagagtaaattatttgtggctttgctgagtgaaggaaggggagcaaggggtggtgcccctggtcccagcatgccccgcgcctgagactggctggaaatgctctgactcctgtgaaggcacagccagcgttgtggcctgagggaggccctgctgggaccctgatctgggccttcctgtcccagggcctatgggcaactgcgttgaaaggacgttcgccaagggccgtgtgtaaatacgaactgcgccatggagaggagaggcactgccggagcccttgccagatctccctccctctctctgtgcagtagctgtgtgtccgaggtcagtgtgcggaatcacagccaaggacgtgaagagatgtacgggggaaagagaagctggggattggatgaaagtcaaaggttgtctactttaagaaaataaaataccctgaatgg

SEQ ID NO: 722 - DNA, 4860 bp, Homo sapiens
gcactgggagacgtgcggttccgggtcgctgctcggctcgccggctgggcggtgggggttggtgacgcgggccggcgctcacgagaggcccgggaggcggggctttgctggcttcccagagagaggcaggacagaatgctttgacctccaagctgttttaaatctagtagataagccagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgcttccgatggaagcagctccagagaagatctttcatcccagcttctgagaaggaatgaacagatacggaagttagaggccagactttctgactatgctgaacaggtccgaaacttgcagaagataaaagagaagcttgaaattgcattagaaaaacaccaggattcttccatgcggaaatttcaagagcagaatgagacattccaagccaacagagccaaaatggcagaaggactggctttggcattagccagaaaggaccaggaatggtcagaaaagatggatcagcttgaaaaggagaaaaatattctgacagcccagttacaggaaatgaagaaccagagtatgaatcttttccaaaggagagatgaaatggatgaattagaggggttccagcagcaggaactaagtaaaataaagcacatgcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagagagatcatgtgatagcttcaaaaacaggtgcagaaagtaagatcacagccctggaacaaaaggaacaagagctccaagcactcattcagcagctttccattgatttgcaaaaggtcactgctgaaactcaagagaaagaagacgttatcacacatttgcaagagaaggttgcatccttggagaagagactagaacagaacttatcaggagaagaacacgtgcaagaactcctgaaagagaaaacacttgctgagcagaatttggaggataccagacaacagctcttggcagccagaagcagccaggctaaggccattaacaccctggagactcgggtgagagaactggagcagaccttgcaggcctctgaggagcagctccaacagagcaagggcattgtggctgcccaggaaactcagatacaggagctcgctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatgagacaactggagcaagaaaatgcagcccttaaagaatgcaggaatgaatatgaacgttctttacaaaatcaccaatttgaactaaagaagctgaaggaagaatggagccaaagagaaattgtgagcgtggccatggctcaagccctggaggaggtgcggaagcaaagggaagagttccagcaacaggcagctaacctgacagccataatagacgagaaggaacagaatctgcgggaaaaaaccgaagtgcttctccagaaagagcaggagattctccagctggagcgaggtcacaactctgccctgctgcagatacaccagctgcaggccgagctggaggccctgaggaccctcaaggcggaggaggctgcagtggtcgcggagcaggaggacctgctgaggctgcggggcccattgcaggccgaagcactctcagtcaatgagtcgcacgtgacctcgagggccatgcaggaccctgtgttccagcttccaactgcaggaagaacaccaaatggtgaggttggggccatggatctcacacagctacagaaggagaaacaggacttggagcagcaacttctggagaaaaataagaccataaagcagatgcagcagcggatgctggagctccggaagactctgcagaaggagctgaaaatcagacccgataatgagctcttcgaagtccgggagaaacctggacctgagatggcaaacatggcgccttccgtcacgaataacactgacctgacagatgcccgcgagatcaactttgagtaccttaaacatgtggttttaaaattcatgtcttgtcgcgaatccgaggcttttcatcttataaaagctgtgtcagtgttgctgaacttttcccaagaggaggagaacatgctcaaggaaactctggaatataagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggccggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacattggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccgtccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaaaaaaaaaaaaaaaaaaaaaaaaaaaaaaaaaaaaaaaaaaaaaaaaaaaaaaaaaaaaaaa

SEQ ID NO: 723 - DNA, 797 bp, Homo sapiens
agtctctgctcttcccagcctctccggcgcgctccaagggcttcccgtcgggaccatgcgcggcagtgagctcccgctggtcctgctggcgctggtcctctgcctagcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccttgggcaatcagcagccttcgtgggattcagaggatagcagcaacttcaaagatgtaggttcaaaaggcaaagttggtagactctctgctccaggttctcaacgtgaaggaaggaacccccagctgaaccagcaatgataatgatggcctctctcaaaagagaaaaacaaaacccctaagagactgagttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacat

SEQ ID NO: 724 - DNA, 1077 bp, Homo sapiens
  Modified_base 969: n = a,c,g, or t
gagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccaccggaggtgggagaaaatctgggcacgatcgggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtcnttgacatttggggggaacagcaggtgccagagctaaaaggtacctttgtctgccattgatccagctcagaacgattggaaataaatttgaaatgtaaccgagcaaaaa

SEQ ID NO: 725 - DNA, 873 bp, Homo sapiens
cagtttgaatcgcggtgcgaccgaaggagtaggtgctgggatcgtcaccgtggcaccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgttcagaccttatttccactctggtggataagttcaataaaggtcatatcccaaactaaaa

SEQ ID NO: 726 - DNA, 2015 bp, Homo sapiens
cggaggcacggaagatgaggaagatgatcaggaggatgatgaaggtgaagagggagatgaagacgatgacgacgatggctctgaggggacctcaggggctgccgagctgggggggcgctcaagctgcgaggatccgggctgcccgcgagacgaggagcgggcgccaggatggggtcgatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggcagggggtgcccaggtggtggctcgaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgcaagtcttacg

SEQ ID NO: 727 - DNA, 13672 bp, Homo sapiens
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgtgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcaactgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggacaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctgctcaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaaagcccgctagaaggtttgggaacgaggggaaagttctcagaactgttgctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctggccctcctgggaaggagggagctgctcagaatgccgcatgacaactgaaggcaacctggaaggttcagggcccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgcccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaagggaaaaaatggaaaccatcaat

SEQ ID NO: 728 - DNA, 3062 bp, Homo sapiens
gacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttaagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgctgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggggaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacaaaaaaaaaaaaa

SEQ ID NO: 729 - DNA, 1362 bp, Homo sapiens
cctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaaa

SEQ ID NO: 730 - DNA, 1192 bp, Homo sapiens
cagatccatcaggtccaagctgtgttgactaccactgcttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtcccccgagatcagagtcctaccgtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagtt

SEQ ID NO: 731 - DNA, 1875 bp, Homo sapiens
ggccggtgctgcgctcctctaattgggactccgagccggggctatttctggcgctggccgggctccaagaaggcatccgcatttgctaccagcggcggccgcggcggagccaggccggtcctcagcgcccagcaccgccgctcccggcaacccggagcgcgcaccgcagccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgcctccttcactgttccctctggcttcccatagtggggcctgggagggttccccctggccttaaaaggggcccaagcccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtgccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttacagttacttgaataaaaaaaatatccttttctggaaaaaaaaa

SEQ ID NO: 732 - DNA, 1769 bp, Homo sapiens
gagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctctaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggcaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaa

SEQ ID NO: 733 - DNA, 1520 bp, Homo sapiens
gaattccgggggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccacttcctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtac

SEQ ID NO: 734 - DNA, 1475 bp, Homo sapiens
cccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaat

SEQ ID NO: 735 - DNA, 1751 bp, Homo sapiens
ccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcatccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaactttcccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccatggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaaaaaaaaacggattccgcg

SEQ ID NO: 736 - DNA, 3085 bp, Homo sapiens
gagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttgggtagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattc

SEQ ID NO: 737 - DNA, 1658 bp, Homo sapiens
ctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcattcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcatgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcgtcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctattt

SEQ ID NO: 738 - DNA, 1610 bp, Homo sapiens
cccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaacttgcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 739 - DNA, 2187 bp, Homo sapiens
gcggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcccactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacag

SEQ ID NO: 740 - DNA, 679 bp, Homo sapiens
gggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacgcc

SEQ ID NO: 741 - DNA, 3110 bp, Homo sapiens
cgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacgcggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaaatcctacaatggcactgtggactgatgtttccttctccgaggggctggagcggggatctgatgaaaaggatcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtgagtttcctctcctgtccgtgtttgtttagtacttttataatgaaaagaaacaagattgtttgggattggaagtaaagattaaaaccaaaagaatttgtgtttgtctgataaaaaaaaaaaaaaa

SEQ ID NO: 742 - DNA, 2472 bp, Homo sapiens
ctgccagggttgggtgcgccgctgaacggatggctgagggagccccgcggatcgttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcacctccatcgtcacgtacctccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggtactatactttctaggcagatctcctttgtgggtttccagcctgtcctttcatcagagcacatggcagggtttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcactgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgagcattctctctggcattggagtctcccaggtgctgtccacatacatgaagaatctggacataagtcgcccagacaagaagagcaagaagcaacaggattccacctaccctattaagattgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaaggctataccacagaacattggctggtcaggatatacaaggtaaaggacctggataatcgaggcttgtcaaggacataaatgtcacgtccagctctgatatcttcgcactgagcacatcacatttaggacgttgaagattttttttttttttttttttttaatatgcagtttgtaagaacaaaactggatggcatccgaattgtctggaagttttgtcttgggcatgatgggctgggccaaatgaaatgatttttataattctaaacaggttaccaaatgaaatgtcatggctttactttggtcaattaaaggggggaattttttta

SEQ ID NO: 743 - DNA, 9517 bp, Homo sapiens; identical to SEQ ID NO: 358

SEQ ID NO: 744 - DNA, 2861 bp, Homo sapiens
ctccgtcccaggggagaaggagaggcgtctgcagggggcagagaccgcagctacctgccgggtgcgccccccacccaggagcgctcgcttcgccccctttcctccccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaatctcggcagacacctgagggtgagttccttccccttgaccaacttgaactggatgtaggttttagtacaggggcagatcaactttttcttgtgtcccccctcacaatttgccacgtgatcgatgccaaaagccccttttatgacctatcccagcgaagcatgcaaactgaacagttcgagattgtcgtcatcctagaaggcattgtggaaacaactgggatgacttgtcaagctcgaacatcatatactgaagatgaagttctttggggtcatcgtttttttcctgtaatttccttagaagagggattctttaaagttgattactcccagttccacgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacagcatatttcgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgcttaaaataaaaaaaaaaaaa

SEQ ID NO: 745 - DNA, 1911 bp, Homo sapiens
actttttggctgttctgaagagtgttactgtgaacattcatgcacaaatttttatgtggggataacttttaactggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgccaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttggataaacagacatttagcaatgctgacattaaaaggaaatgtatttctatacaagattattagctgtaatacaagatatttatttaaccaatgaccttatggctgagagttgaattgtggttcagtattcattgatctcactgctttaaaacatgctccttttgttcaagcag

SEQ ID NO: 746 - DNA, 1882 bp, Homo sapiens
gggcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggctttggctttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacacatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttggagaatctaagtcaaactcactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaa

SEQ ID NO: 747 - DNA, 2238 bp, Homo sapiens
gtccttcggtgtctgggtgtggtgagtagaggtgtgtgtcacaaagtacagaccattgtgtgtgacaaagcccatcgtgtgtctgtgtgtgtctttatccacgtggatggacgtctctttcttgctctgccccaagacacaccctagcccctccttattctcaaaagggggagctggggagcctccccctaccctggggcctcccctgcccctccccgccctgcctggccgtcaccactccccagagggcacagggctctgctgtgcctcagagcaaaagtcccagagccagcagagcaggctgacgacctgcaagccacagtggctgccctgtgcgtgctgcgaggtgggggaccctgggcaggaagctggctgagccccaagaccccgggggccatgggcggggatctggtgcttggcctgggggccttgagacgccgaaagcgcttgctggagcaggagaagtctctggccggctgggcactggtgctggcaggaactggcattggactcatggtgctgcatgcagagatgctgtggttcggggggtgctcgtgggcgctctacctgttcctggttaaatgcacgatcagcatttccaccttcttactcctctgcctcatcgtggcctttcatgccaaagaggtccagctgttcatgaccgacaacgggctgcgggactggcgcgtggcgctgaccgggcggcaggcggcgcagatcgtgctggagctggtggtgtgtgggctgcacccggcgcccgtgcggggcccgccgtgcgtgcaggatttaggggcgccgctgacctccccgcagccctggccgggattcctgggccaaggggaagcgctgctgtccctggccatgctgctgcgtctctacctggtgccccgcgccgtgctcctgcgcagcggcgtcctgctcaacgcttcctaccgcagcatcggcgctctcaatcaagtccgcttccgccactggttcgtggccaagctttacatgaacacgcaccctggccgcctgctgctcggcctcacgcttggcctctggctgaccaccgcctgggtgctgtccgtggccgagaggcaggctgttaatgccactgggcacctttcagacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccag

SEQ ID NO: 748 - DNA, 3732 bp, Homo sapiens
  Modified_base 50: n = a,c,g, or t
cctcccaggcgtccccaccctaggaggctgcatgcggattgaagacgtgngcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaacgtgagcccctgatagactccgtgctccagggtttcaatggcacggtgtttgcctatggccagacgggcactggcaagacctataccatgcagggggacctggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaggaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggataaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcgggtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctcagttcgtgttggggagatgccctcgcctgagccgtctgggcctaccgtggtcactgcgtagctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctaccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaaaa

SEQ ID NO: 749 - DNA, 1976 bp, Homo sapiens
gccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttaaaaaaaa

SEQ ID NO: 750 - DNA, 1752 bp, Homo sapiens
ctgctccttctaggatctccgcctggttcggcccgcctgcctccactcctgcctccaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaccc

SEQ ID NO: 751 - DNA, 1518 bp, Homo sapiens
atgacctgcggatcaggatttggtgggcgcgccttcagctgcatctcggcctgcgggccgcgccccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatccgcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaatgagctgaaccgcatgatccaaaggctgacggccgaggtggagaatgccaagtgccagaactccaagctggaggccgcggtggctcagtctgagcagcagggtgaggcagccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttag

SEQ ID NO: 752 - DNA, 5815 bp, Homo sapiens
gaaggcagtttccggagggaaggggtagggttggggtgggggcgctctccgcccggtgttgcgctccttcccagaatccgctccggcctttccttcctgccgcgattcccaactttgctcaaagtcgctggactctaagctgtcggagggaccgctggacagacctgggaactgacagagggcctggagggaaacaggccaaagacccacaggcagagttgacacggaaccccaaagcaaggaggagggctcgggccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgaacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacgggccaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtgcgttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggcgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccaaaaaaaaa

SEQ ID NO: 753 - DNA, 3723 bp, Homo sapiens
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttgttgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggcggtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggaggtgtaatggaatcggaatcaagccactcggcaggcatggagctataactaagcatccttagggttctgcctctccaggcattagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggacaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctcccaggaagaaagaatgttactgccttaataaaaaatgaaaagagaatgatgctcaaaatctttccaaataaaatgttccctat

SEQ ID NO: 754 - DNA, 1272 bp, Homo sapiens
gccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtagctcttgaacaaataaaattaactattgtagtgtg

SEQ ID NO: 755 - DNA, 1620 bp, Homo sapiens
caaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaggacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatcttcgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacctccgttttgatgagaatgctgtggtccgcaacacccagatcgacaactcctgggggtctgaggagcgaagtctgccccgaaaaatgcccttcgtccgtggccagagcttctcagtgtggatcttgtgtggagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcaaaaaaaaaaaaaaaaaaaaa

SEQ ID NO: 756 - DNA, 3332 bp, Homo sapiens
gcgccgagccggtttccccgccggtgtccgagaggcgcccccggcccggcccggcccggcccgcgccctccgcccccgcctccccgggccggcggcggtgggcgagctcgcgggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccaccc

SEQ ID NO: 757 - DNA, 1493 bp, Homo sapiens
tgagcgggggatgatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcactggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaacc

SEQ ID NO: 758 - DNA, 894 bp, Homo sapiens
cagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactggtaacggagacggccgaccccggggcacaggcccagcaaggactggggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaa

SEQ ID NO: 759 - DNA, 2136 bp, Homo sapiens
gccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcactttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctaaactcgtgccgctcgtgccgaattcctgcag

SEQ ID NO: 760 - DNA, 1145 bp, Homo sapiens
gctccggccagccgcggtccagagcgcgcgaggttcggggagctccgccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgcccaagtgggccagctgccctcacttctggggtggatgatgtgaccttccttgggggactgcggaagggacgagggttccctggagtcttacggtccaacatcagaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgcccaaatccagccagtcctgccccagcccacccccacattggagccctcctgctgctttggtgcctcaaataaatacagatgtcccc

SEQ ID NO: 761 - DNA, 6928 bp, Homo sapiens
ggcgggagcgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcgactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaacataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtggttatggagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcagtgatcctcccgcctcggcctcccaaagtgctgggattacaggcatgagccaccgcgcctggcctctgcttactttttatatagcaaaatgattccccttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcttgtgatctgtgtacaattttagtcactaagactttcctccaagaactaagccaacttgatgtgaaaagcacggctgtatataatggtgatgtcataataaagttgttttatcttttaagtaaaaaaaaaaaaaaaaaaaaa

SEQ ID NO: 762 - DNA, 2298 bp, Homo sapiens
tcggccgagcccagagacagccagttcctctcccgccgcgccgggccgcgtgccgctcgctccccggccgtggcgcctccgggccagacgcgctgcagcctccagcccgcggcaagcgggcggggcggccgcgccacccccggccccgcgccagcagcccctcgccgcgcgtccagcgttcccggccagcagcctccccatacgcagtcctgctggaccgccccgtcgcgccccccactctgaactcaagtcaccgtggagctccgccgccccgaaactttcacgcgagcgggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactaatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgttt

SEQ ID NO: 763 - DNA, 2589 bp, Homo sapiens
caaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctcctcggccgagaaaggtgagccggccgccgccgctgcccccgaggccggggccagcccggtagagaaggaggcccccgcggaaggcgaggctgccgagcccggctcggccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactgttttggagaacttgtctacaaccagggattgattttaaagatgtctttttttattttacttttttttaagcaccaaattttgttgtttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgt

SEQ ID NO: 764 - DNA, 1390 bp, Homo sapiens
gggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttcctttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaaaaaaaaaaaaaaaaa

SEQ ID NO: 765 - DNA, 698 bp, Homo sapiens
ggcgccgccgcaaacgtcagtgtacgaggcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaatttttattattttataaagacctgaacatgtgaaaaaaaaaaaaaaaaaa

SEQ ID NO: 766 - DNA, 2212 bp, Homo sapiens
ccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctacgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgaaataaccaacattaaaactcataattattttgttgaccattttgttaaaatctacttttc

SEQ ID NO: 767 - DNA, 2545 bp, Homo sapiens
atccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcag

SEQ ID NO: 768 - DNA, 1973 bp, Homo sapiens
gggatattggagtagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcggctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgtttt

SEQ ID NO: 769 - DNA, 1778 bp, Homo sapiens
tagaagtttacaatgaagtttcttctaatactgctcctgcaggccactgcttctggagctcttcccctgaacagctctacaagcctggaaaaaaataatgtgctatttggtgagagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatctccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcacaaacttgttcctcactgctgttcacgagattggccattccttaggtcttggccattctagtgatccaaaggctgtaatgttccccacctacaaatatgtcgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctattctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaagcaagataattctatttgaagcatgctctgtaagttgcttcctaacatccttggactgagaaattatacttacttctggcataactaaaattaagtatatatattttggctcaaataaaattg

SEQ ID NO: 770 - DNA, 1771 bp, Homo sapiens
cgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgt

SEQ ID NO: 771 - DNA, 5185 bp, Homo sapiens
gggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacagactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaagcgaggaaaagctgccaacaacagaacgctgagctcctgagcatcacagagatacatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcggtgacctcacaagtatccacaccatcgaggaattggactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatttcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaataaaaaaaaaaaaaaa

SEQ ID NO: 772 - DNA, 3879 bp, Homo sapiens
ggcacgaggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctccactgtcttcttcaggtcctgagattacacggtggagtgtatgcggtctaggaatgagacaggacctagatatcttctccagggatgtcaactgacctaaaatttgccctcccatcccgtttagagttatttaggctttgtaacgattgggggaataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctcaaagaggtgactgggccctgcctctgtttgacaaacctctaacccaggtcttgacaccagctgttctgtcccttggagctgtaaaccagagagctgctgggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtccctcaaggggccatcctgtcccaccatgcagtgccccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggtttttaaaaaattgtttttggaggggtttatgctcaatccatgttctatttcagtgccaataaaatttaggtgacttcaaaaaaaaaaaa

SEQ ID NO: 773 - DNA, 2808 bp, Homo sapiens
ggggggggggggcagcctctcgggaagagccaatcaggggcgagcgtcttctcgtcgcacgaggcccggcgcggattggcggcgcgcgtctcccacttcccctcggaggaaaggctcagctcccagcgcgcccctcccgtctccgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggctggggggcgccgcgggggccgcggaggagcgccgcgtcaaggtctccagcctgcccttcagcgtggaggcgctcatgtccgacaagaagccgcccaaggagtcgcccgctgtgcctcccgaaggcgcctcggccggggcccacctgcggccactgctgctgtcggggcaccgcgctcgggaagcgcacagccccgggccgctggtgaagcccttcgagaccgcctcggtcaagtcgggaaattcagaagatggagcggcgtggatgcaggaacccggccgatattcgccgccgccaagacatatgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagcgccaaggcgaaaagactgcaggaggcggaactggaaaagctgaaaatggctgcaaaacctatgctaccctccagcttcagtctccccttccccatcagctcgcccctgcaggcagcgtccatatacgcagcatcctacccgttccatagacctgtgcttcccatcccgcccgtgggactctatgccacgccagtgggatatggcatgtaccacctgtcctaaggaagaccagatcaatagactccatgatggatgcttgtttcaaagggtttcctctccctctccacaaaggcatagccagccagtactcctgcgctgctaagccctcgacgttgcaccccaccccctctaacggctagctgacagggccacaccacatagctgaaatttcgttctgtaggcggaggcaccaagccctgcttttcttggtgtaacttccagagtccccccttttttcccttgcacaaaagcttggctctgatggtttttttggcatgatgtatatatatatatacgaaaaatactacagaccctttttatcagcagacgtaaaaattcaaattattttaaaaggcaaaatttatatacatatgtgctttttttctatatctcaccttcccaaaaagacacatgtgtaagtccatttgttgtattttcttaaagagggagacaaattcggaggagcgccgcgtcaaggtctccagcctgcccttcagcgtggaggcgctcatgtccgatttgcaaaaatgtgctaaagtcaatgatttttaccgggattattgacttctgcttatacaagaagccgcccaaggagtcgcccgctgtgcctcccgaaggcgcctcggccggcctgcggaaaaacaaaagaaaacagacacaatgcagcagccagaaaatattagatatggagagattatggccactgctgctgaccggccacggcgtccgggaagcgcacagccccgggccgctggtgatcaaagtgaacccacatcatatttctgcattttacttgcattaaaagaaacctctttataagcccttcgagaccgcctcggtcaagtcgggaaattcagaagatggagcggcgtggatgctacatacgttgttcctatctcccgcccacgcccacacatatttttaaagtttttaggaacccggccgatattcgccgccgccaagacatatgagccctaccacctgcaccctgacctttttaagaatatttttgtaagaccaatacctgggatgagaagaatccgtagactgccggaaacacaagaccaatcggaagccgcgcacgccctttaccacatcccagctcctcgccctggaggtgaggtagaaaaattagaaatacttcctaattcttctcaaggctgttggtaactttggagcgcaagttccgtcagaaacagtacctctccattgcagagcgtgcagagttctctatttcagataattggagagtaaaatgttaaaacctgtgagaggattgtacagctctctgaacctcacagacccaggtcaaaaggttctgagaaatactaggtacattcatcctcacagattgcaaaggtgctttgggtgggggtttagtaattttctgcttaaaaaatgagtatcttgtaaccattacctatatctaaatattcttgaacaattagtagatccagaaagaaaaaaaaaatatgcttctctgtgtgtgtacctgttgtatgtcctaacttattagaaaaattttatatctttttacatgtggggggcagaaggtaaagcatgtttgacttgtgaaaatgggatgtcaaacagccataagttccctggtattcaccttcctgtccatctgtcccctccatcggtatacctttatccctttgaaagggtgcttgtacaatttgatatattttattgaagagttatctcttattctgaattaaattaagcatttgttttattctgaattaaattaagcatttgttttattgcagtaaagtttgtcca

SEQ ID NO: 774 - DNA, 415 bp, Homo sapiens
ccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgcmaagtgtgcccagggctgcatctgcaaagggacgtcagacaagtgcagctgctgtgcctgatgccaggacagctgtgctctcagatgtaaatagagcaacctatataaacctggatttttttttttttttttttgtacaaccctgacccgtttgctacatctttttttctatgaaatatgtgaatggcaataaattcatctagactaaaaaaaaaaaaaaaaaaaaaaaaaaaaaaaa

SEQ ID NO: 775 - DNA, 1721 bp, Homo sapiens
gaattccctggctgcttgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccgcccccgggctccaccgcccccccagcccacggtgtcacctcggccccggacaccaggccgcccccgggctccaccgcgcccgcagcccacggtgtcacctcggccccggacaccaggccggccccgggctccaccgcccccccagcccatggtgtcacctcggccccggacaacaggcccgccttggcgtccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgccctctgagctgagtggccagccagtgccattccactccactcagggctctctgggccagtcctcctgggagcccccaccacaacacttcccaggcatggaattcc

SEQ ID NO: 776 - DNA, 2627 bp, Homo sapiens
gctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttg

SEQ ID NO: 777 - DNA, 2561 bp, Homo sapiens
gcctgagtgagtctctggcgtcccaaattgcctgtttttctcgcaggctctattccgttcgctggttcgccacctcaggggaacgatggccatggagtccacagccactgccgccgtcgccgcggacgtggtttctgccgacaaaattgaagatgtccctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgcaaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctgcttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtcccgagtggaaatgaagtttcggaaaacatggaggaggaggctgagaatcagctgaaacgcggagcagcagtggaggggacactggaggctggagctacagttgaaagcactgcatgttaagagggggcacagcctcctcccaagggaaagtgtttttgtatataatgtattttttcacttttggaggattctttttgtataacttcaataaagattgtaagcaaaaaaaaaa

SEQ ID NO: 778 - DNA, 2119 bp, Homo sapiens
ggcacgagtaggggtggcgggtcagtgctgctcgggggcttctccatccaggtccctggagttcctggtccctggagctccgcacttggcgcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatcttaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggccccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatattaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtta

SEQ ID NO: 779 - DNA, 2669 bp, Homo sapiens
cagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccatatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtatagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaaaaaaaaaaaaa

SEQ ID NO: 780 - DNA, 670 bp, Homo sapiens
cggccacgaggcggaatcccttctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 781 - DNA, 3671 bp, Homo sapiens
gaattccgacaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctgccatggcccattcttcatcatttgtaagttcaacaaaagttctcacatggagtcccacctcttcagaggttgcacatttgtttttaagactgaattcactactgatcccatcgcctggccgagacagtcattactccattaacatcctcactgtttagacacataactgtggtacaggattggaaattataaacaaaagtgaaagtgccaacaaattattgatagctgataatgtttcatatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatcctagccctgtgcactcagcactcataggatcatccagactctcatgcggcatgcagtctaatcatgacaaataatgctgctactctgatatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcattttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgtttagttcatcatgtagcatcaaaa

SEQ ID NO: 782 - DNA, 1963 bp, Homo sapiens
gaaacgtcccgtgtgggaggggcgggtctgggtgcggctgccgcatgactcgtggttcggaggcccacgtggccggggcggggactcaggcgcctggcagccgactgattacgtagcgggcggggccggaagtgccgctccttggtgggggctgttcatggcggttccggggtctccaacatttttcccggtctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttcctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctcaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgcctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaacttttcacagtgaagtgcctttttcctagaagtggtttgtagactcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcatatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaatt

SEQ ID NO: 783 - DNA, 2062 bp, Homo sapiens
gtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggc

SEQ ID NO: 784 - DNA, 2557 bp, Homo sapiens
  Modified_base 200: n = a,c,g, or t
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttnatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatgg

SEQ ID NO: 785 - DNA, 1535 bp, Homo sapiens
ggcacgaggaggtcacctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgatgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctgctccctcaaaaaaaaaaaaaaaa

SEQ ID NO: 786 - DNA, 1978 bp, Homo sapiens
ggcacgagggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagggaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaaacaatgtgatggacgtcaaggacagatctttcctgaaatcatgccactttggccccaagaaccactactgccccatcttccgactgggctccatcgtccgctgggccgggagcgacttccaggatatagccctgcgaggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccacagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaaaaaaaaaaaaaaaaaaaaaaaaaaaaaaaaaa

SEQ ID NO: 787 - DNA, 4403 bp, Homo sapiens
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatccc

SEQ ID NO: 788 - DNA, 2823 bp, Homo sapiens
cccccgcgccgcgcagccccggccgccaggccttagcccgccccggcccccgccaggccgcgtccccctcccctcccctcccccgcgcgccacccgcgcccgcccccgcccggcaccgcggacccacccggacctcggcggggagatggaggtcctggcggcagagaccacgtcccagcaggagcggctgcaggccatcgcagagaagcggaagcggcaggcggagatcgagaacaagcgccggcagctggaggacgagcggaggcagctgcagcacctgaagtccaaggcactgcgggagcgctggctgctggaggggacgccgtcctcggcctcagagggggatgaggacctgaggaggcagatgcaggacgacgagcagaagacacggctgctggaggactcggtgtccaggttggagaaggaaattgaggtgctggagcgtggagactccgccccagccgctgccaaggagaacgcggcggccccgagcccagtccgggccccagccccgagtccagccaaggaggagcgcaagacagaggtggtgatgaattcacagcagacgccggtgggcacgcccaaagacaagcgagtctccaacacgcccctgaggacggttgacggctcccccatgatgaaggcagccatgtactcggttgagatcactgtggagaaggacaaggtgacaggggagaccagggtgctgtccagcaccacgctgctccctcggcagccgctccctctgggcatcaaagtctacgaggacgagaccaaagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggtcgcgcccaccggggtcctggcgggtgggacccgcagcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccaagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcggatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagcccc

SEQ ID NO: 789 - DNA, 4069 bp, Homo sapiens
ctctattcgacattctctttggattgttttgctataacttgaaatttgggatgtcacaaacgaaactgtcatctgtttccgccaaactgtggttctgctaatctcccaggctggcagcattggagacttgctgacttctttcatcccccactcttttcacctgaaattcctttccttggttttgctctaagtcctatgcttcagtcaggggccaaccaaatctcactgcctcctttttatcatgaagcctttgatcactgatagttctttttatatcttgaaaaatcacccttcccagtacagttaatatttagtatctctactcatcttggcacttactcacagctccataattcagtgtttctcgtacctcttcatggtgatggggagccctttggaggtggtgactgtgctttatactcctcatgatgcttcacatgtggcaggcgtggagtgcccggaggcggccctcctgattctggggcctcccaggatggagcccctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatgcgagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggtggcagaggaccaggaggagaagcaaccacagctcattgtgatgggcaacctggaccgtgagcgctgggactcctatgacctcaccatcaaggtgcaggatggcggcagccccccacgcgccacgagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgccgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggattaggctgagtgaagattaagggagggtgtgctctgtggtctcctccctgccctctccccactggggagagacctgtgatttgccaagtccctggaccctggaccagctactgggccttatgggttgggggtggtaggcaggtgagcgtaagtggggagggaaatgggtaagaagtctactccaaacctaggtctctatgtcagaccagacctaggtgcttctctaggagggaaacagggagacctggggtcctgtggataactgagtggggagtctgccaggggagggcaccttcccattgtgccttctgtgtgtattgtgcattaacctcttcctcaccactaggcttctggggctgggtcccacatgcccttgaccctgacaataaagttctctatttttgg

SEQ ID NO: 790 - DNA, 4076 bp, Homo sapiens
gcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgcgccggcaacctcacccttcgccgctgccgccgccgccgctgcactcgggggagcggacgctagctcgccggcgggagccgggacgccggaggctggtgccacttcgctggtgccggagggggcggcgcgcgagagcctggtggccctggtcagcacctcggacagggactcgggcgccaacgggcaagtgcgctgcgccctctatgggcacgagcacttccggctgcagccggcctacgcgggcagctacctggtggtgaccgcggcgtcgctggaccgcgaacgcatcgccgagtacaacttgacgctggtggccgaggatcgcggcgcgcccccgctgcgcacagtgcggccctacacggtgcgtgtgggcgacgagaacgacaacgcgccgctcttcacgcggccggtctatgaggtgtcggtgcgcgagaacaacccgccaggcgcctacctggccacggtggccgcccgcgaccgggacctgggccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggaggtgcgcaaagggggggccctccgggaagagcggcccggggcggcgggcggcggagcctcggctcccggctccccggaggaggccgcccggggagccgggcccaggcccaacatgttcgacgtgctcaccttccctggcaccggcaaagcgccctttggcagccccgcggcggacgcgcctccgcctgcggtcgccgcggccgaagtgccgggctcagagggcggcagcgccactggggaaagcgcctgtcacttcgaggggcagcagcggctccgcggcgcgcacgccgagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtttgaagaaaaaaaaaaaaaaaaaaaaaaaaaaaaaaaaaaaaaaaaaaaaaaaaaaaaaaaaaaaaaaaaaaaaaaaaaaaa

SEQ ID NO: 791 - DNA, 4068 bp, Homo sapiens
gaattcctcctctcttcaccccgttagctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttcacccgaattttgactgtttcatttagaagaaaagcaaaatgagaaaaagctttcctcatttctccttgagatggcaaagcactcagaaatgacatcacataccctaaagaaccctgggatgactaaggcagagagagtctgagaaaactctttggtgcttctgcctttagttttaggacacatttatgcagatgagcttataagagaccgttccctccgccttcttcctcagaggaagtttcttggtagatcaccgacacctcatccaggcggggggttggggggaaacttggcaccagccatcccaggcagagcaccactgtgatttgttctcctggtggagagagctggaaggaaggagccagcgtgcaaataatgaaggagcacgggggcaccttcagtagcaccggaatcagcggtggtagcggtgactctgctatggacagcctgcagccgctccagcctaactacatgcctgtgtgtttgtttgcagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgctacagtccctggccctgcttcccatcctcctctcttcaccccgttagctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagtcttttacttttgtatagcttgataggggcaggggcaatgggatgtagtttttacccaggttctatccaaatctatgtgggcatgagttgggttataactggatcctactatcattgtggctttggttcaaaaggaaacactacatttgctcacagatgattcttctgattcttctgaatgctcccgaactactgactttgaagaggtagcctcctgcctgccattaagcaggaatgtcatgttccagttcattacaaaagaaaacaataaaacaatgtgaatttttataataaaaaaaaaaaaaaggaattc

SEQ ID NO: 792 - DNA, 2040 bp, Homo sapiens
gaattccgggcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgagaaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgactgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccatgaacccg

SEQ ID NO: 793 - DNA, 1199 bp, Homo sapiens
ccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccaactgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccct

SEQ ID NO: 794 - DNA, 1404 bp, Homo sapiens
tcaggggtaggagcgggagccgagaggaggcggaggagatggcgtcccagccgccacctccccccaaaccctgggagacccgccgaattccgggagccggaccgggaccaggaccgggccccactttccaatctgctgatttgggtcctactttaatgacaagacctggacaaccagcacttaccagagtgcccccacctattcttccaaggccatcacagcagacaggaagtagcagtgtgaacacttttagacctgcttacagttcattttcttctggatatggtgcctatggaaattcattttatggaggctatagtccttatagttatggatataatgggctgggctacaaccgcctccgtgtagatgatcttccacccagtagatttgttcagcaagctgaagaaagcagcaggggtgcatttcagtccattgaaagtattgtgcatgcatttgcctctgtcagtatgatgatggatgctaccttttcagctgtctataacagtttcagggctgtattggatgtagcaaatcacttttcccgattgaaaatacactttacaaaagtgttttcagcttttgcattggttaggactatacggtatctttacagacggctacagcggatgttaggtttaagaagaggctctgagaatgaagacctctgggcagagagtgaaggaactgtggcatgccttggtgctgaggaccgagcagctacctcagcaaaatcttggccaatattcttgttctttgctgttatccttggtggtccttacctcatttggaaactattgtctactcacagtgatgaagtaacagacagcatcaactgggcaagtggtgaggatgaccatgtagttgccagagcagaatatgattttgctgccgtatctgaagaagaaatttctttccgggctggtgatatgctgaacttagctctcaaagaacaacaacccaaagtgcgtggttggcttctggctagccttgatggccaaacaacaggacttatacctgcgaattatgtcaaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcaggtgttttgctgctagaaattattaaagttacacactagta

SEQ ID NO: 795 - DNA, 2914 bp, Homo sapiens
gcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgaccggcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctcgaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcctggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcacccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccgagctgcccctccccagcccccacccatgccagcgcacgcgccagggctcagatggggcctgggctgttgtgtctggagcctgcaggcaggtgggggctgcgtccctgctcagcccatcccctgcctctactccctggccacctgccaggcctccctccggctggtgtcttgagaccagcctgccaggcctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgccatcggtctccggaga

SEQ ID NO: 796 - DNA, 2320 bp, Homo sapiens
gggccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatctgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagcatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctaca

SEQ ID NO: 797 - DNA, 2566 bp, Homo sapiens
ggcacgagttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatataccctttggatttcaaacagtaacatcggatgtaaacaaacttagttccttttactcactgaaactaatcaagcggctctacgtagacaaatctctgaatctttctacagagttcatcagctctacgaagagaccctatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaatttcctgaatcagaaacaaaagaatgtcctttcagactcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagacctttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaacctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatgtggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttgggtggataagctatccctgttgccggttcatggattacttctctataaaaaatatatatttaccaaaaaattttgtgacattccttctcccatctcttccttgacatgcattgtaaataggttcttcttgttctgagattcaatattgaatttctcctatgctattgacaataaaatattattgaactacc

SEQ ID NO: 798 - DNA, 2623 bp, Homo sapiens
gaggaggcccgagaggagtcggtggcagcggcggcggcgggaccggcagcagcagcagcagcagcagcagcaaccactagcctcctgccccgcggcgttgcgacgagccccacgagccgctcaccccgccgttctcagcgctgcccgaccccgctggcgcgcctcccgccgcagtcccggcagcgcctcagttgtcctccgactcgccctcggccttcgcgcagcgcagcacagccgcacgcaccgcagcacagcacagcacagcccaggcatagcttcggcacagccccggctccggctcctgcggcagctcctctggcacgtccctgcgccgacattctggaggttggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctacaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggcagaaccctgccaatggaactctttcttcatcatgagttctgctgaatgccgcgatgggtcaggtaggggggaaacaggttgggatgggataggactagcacattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaaatgcacaaaccaagcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatgggaggggccattgctgactgtgtatataggataattatgaaacacagttctggatggtgtgccttccagatcctctctggggctgtgttttgagcagcaggtagcctgctggttttatctgagtgaaatactgtacaggggaataaaagagatcttattttttttttatacttgcgtttggaataaaaaccctttggcttt

SEQ ID NO: 799 - DNA, 1743 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaaggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggcaatgggagagctcttgttattattaatattgttgccgctgttgtgttgttgttattaattaatattcatattatttattttatacttacataaagattttgtaccagtgg

SEQ ID NO: 800 - DNA, 4242 bp, Homo sapiens
gaattcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgatgacgtcgtgcaggccatcaaagaccacgcctttgttacctcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgctgatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctgaggttcaggaggatgtatgccctcatccagcactaccgcgagacgcacctgccgtgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatacggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaaggagcagggcgatcctccggtggagtttgccacagacagggtggaggagctctttgagtggtttcagagcatccgagagatcacgtggaagattgacagcaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatggcaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccactccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaacttctaacttatatctttatagaggattccccaaaatgtgctcctcatttttggcctctcatgttccaaacctcattgaataaaaagcaatgaaaaccttg

SEQ ID NO: 801 - DNA, 3609 bp, Homo sapiens
ggcacgaggagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgctcgtgccgaattc

SEQ ID NO: 802 - DNA, 2745 bp, Homo sapiens
ggcccagctgctgagaggagttgcctgagagtgacctttgcatctgcctgtccagccagcatggaaccaaagcggatcagagagggctaccttgtgaagaaggggagcgtgttcaatacgtggaaacccatgtgggttgtattgttagaagatggaattgaattctataagaagaaaagtgacaacagccccaaaggaatgatcccgctgaaagggagcactctgactagcccttgtcaagactttggcaaaaggatgtttgtgtttaagatcactacgaccaaacagcaggaccacttcttccaggcagccttcctggaggagagagatgcctgggttcgggatatcaataaggccattaaatgcattgaaggaggccagaaatttgccaggaaatctaccaggaggtccattcgactgccagaaaccattgacttaggtgccttatatttgtccatgaaagacactgaaaaaggaataaaagaactgaatctagagaaggacaagaagatttttaatcactgcttcacaggtaactgcgtcattgattggctggtatccaaccagtctgttaggaatcgccaggaaggcctcatgattgcttcatcgctgctcaatgaggggtatctgcagcctgctggagacatgtccaagagtgcagtggatggaactgctgaaaaccctttcctggacaaccctgatgccttctactactttccagacagtgggttcttctgtgaagagaattccagtgatgatgatgtgattctgaaagaagaattcagaggggtcattatcaagcagggatgtttactgaagcaggggcatagaaggaaaaactggaaagtgaggaagttcatcttgagagaagaccctgcctacctgcactactatgaccctgctggggcagaagatcccctgggagcaattcacttgagaggctgtgtggtgacttcagtggagagcaactcaaatggcaggaagagtgaggaagagaacctttttgagatcatcacagcagatgaagtgcactatttcttgcaagcagccacccccaaggagcgcacagagtggatcaaagccatccagatggcctcccgaactgggaagtaaagagactcctgcattcctcctcccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccagcctcagggcctcttctggaaaatgaagaaattcaactagtagattcctgaggtccccctagcttaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgacttctattacttttggcagcctggaaagttgtgtcttctgggaaagagacccggggaggccaggagtagctgagggtcctttctgtgcccttaaaccgcccagaggagccctattccactctggttttaggctgatctgagagggtctccctttgttcctttctggagcatttctctaacgtttattacaattaggagggggaccccacatctgtgagattctgtttcatttgaggtttacagaaaaaaaaaagtggccagatgtgttccccccatgggtgagaggcctgggcaactgcctggtgaatgtgtcttgcggcagctgcagcaagtggaggggctgaactactggccagctcactggatgatgggttaatacaacaactgcactgtaaggactcagagccacacagaacttctgagaggggctgttagcattgcgcagcatcttcagttctccagtaaatgatattgcgttcgtgcctcagctttaagcacaagtagcagcagctcctgcttgagttctgagggcatcatggccctatgattaaccagagtgatctaacctagactaaaattgggaacttatttgcaatttttgaccctgaccactaactagtgattcttctccaaaattgagaaagacagcacccattgaaacagatatgtgtgtgaaagtatatttttcaattccagatttttaattttaaggctccaggaaagaaaggagagtagaacatttttcctcattttatcaaatcctctcttgccctccctcaattcccctgtaacattcctgaagctgttcccactcccagatggttttatcaatagcctagaggtaaagaactgtctttttctctgattctttaataaattatctttatagaatatgcacaagtttttctacactcagtgttaaagtatttattaatgggaagtcaacttaatgttttgaaataaatatatgactctgtttaat

SEQ ID NO: 803 - DNA, 954 bp, Homo sapiens
actgggcggaccgcggcggcagcatgagcggcgcagaccgtagccccaatgcgggcgcagcccctgactcggccccgggccaggcggcggtggcttcggcctaccagcgcttcgagccgcgcgcctacctccgcaacaactacgcgccccctcgcggggacctgtgcaacccgaacggcgtcgggccgtggaagctgcgctgcttggcgcagaccttcgccaccggtgaagtgtccggacgcaccctcatcgacattggttcaggccccaccgtgtaccagctgctcagtgcctgcagccactttgaggacatcaccatgacagatttcctggaggtcaaccgccaggagctggggcgctggctgcaggaggagccgggggccttcaactggagcatgtacagccaacatgcctgcctcattgagggcaagggggaatgctggcaggataaggagcgccagctgcgagccagggtgaaacgggtcctgcccatcgacgtgcaccagccccagcccctgggtgctgggagcccagctcccctgcctgctgacgccctggtctctgccttctgcttggaggctgtgagcccagatcttgccagctttcagcgggccctggaccacatcaccacgctgctgaggcctggggggcacctcctcctcatcggggccctggaggagtcgtggtacctggctggggaggccaggctgacggtggtgccagtgtctgaggaggaggtgagggaggccctggtgcgtagtggctacaaggtccgggacctccgcacctatatcatgcctgcccaccttcagacaggcgtagatgatgtcaagggcgtcttcttcgcctgggctcagaaggttgggctgtgagggctgtacctggtgccctgtggcccccacccacctggattccctgttctttgaagtggcacctaataaagaaataataccc

SEQ ID NO: 804 - DNA, 2187 bp, Homo sapiens
gaattccggcttgggcgcaggtcggagctgggtgggccggctccccggcctggcttgggcgaccatgtccgcatccgcccagcagctggcggaggagctgcagatcttcggcctagactgcgaggaggctctaattgagaaattggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggagtctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcaggaggacttgtgcagccgggcctgcctgtgagtggtgcctctcctggaagaagctcttgcttctcagtccatgctccgtgtccagaagtaagccagctgtggatcccgcccactcagaaaaggcgagaaggctttgtgattttctacatgaatcaaacacagaaacaccggaattcc

SEQ ID NO: 805 - DNA, 1259 bp, Homo sapiens
ccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacc

SEQ ID NO: 806 - DNA, 3590 bp, Homo sapiens
cctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaa

SEQ ID NO: 807 - DNA, 1182 bp, Homo sapiens
gaattccgctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataacc

SEQ ID NO: 808 - DNA, 1704 bp, Homo sapiens
cggagccatgcagtacccgcaccccgggccggcggcgggcgccgtgggggtgccgctgtacgcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagagctgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacaaaaaaaaaaa

SEQ ID NO: 809 - DNA, 3036 bp, Homo sapiens
gctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatccagcacctattgaattaccatagagtaatgatgtaacagtgcaagatttttttttttaagtgacataattgtccagttataagcgtatttagactgtggccatatatgctgtatttctttgtagaataaatggtttctcattaaactctaaagattagggaaatggatatagaaaatcttagtatagtagaaagacatctgcctgtaattaaactagtttaagggtggaaaaatgaaaatttttgctaattatcaatgggatatgattggttcagttttttttttccagagttgttgtttgccaagctaatctgcctggtttatttatatcttgttattaatgtttcttctccaattctgaaatacttttgagtatggctatctatacctgccttttaagtttgaaactaactcatagatgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttcctcctttttattcagctagaatttctggtgggttgatggtagggtataatgtgtctgtgttgcttcaaattggtctgaaaggctatcctgctgaaagtcctgctttcctatctagcatttattcctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattatgttcttacaagcttaaagcttgatttgatct

SEQ ID NO: 810 - DNA, 3259 bp, Homo sapiens
gacgcgcgccgggagccggcggccgggccagccggcgccggggcccagtgcgccgcgctcgcagccggtagcgcgccagccgtaggcgtcgctcggcagccgcggggccctaggcgtgccggggagggggcgagggcggccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatgcctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctgccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaag

SEQ ID NO: 811 - DNA, 2261 bp, Homo sapiens
ccgcggttccggctgctccggcgaggcgacccttgggtcggcgctgcgggcgaggtgggcaggtaggtgggcggacggccgcggttctccggcaagcgcaggcggcggagtcccccacggcgcccgaagcgccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttaccttttttgtttaaaaaaaaaaaag

SEQ ID NO: 812 - DNA, 3742 bp, Homo sapiens
gaattccttctctcctcctcctcgcccttctcctcgccctcctcctcctcctcgccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcacgttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcagcggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaaaaaaaaaaaaa

SEQ ID NO: 813 - DNA, 3920 bp, Homo sapiens
caacggaaatagtgcttaccagcaccttagaatgatgctgctcaggaccagtccaacactgaatgtatctgcactgtgaggagaatgttcatagaagcctgttgtgtgcatatttattcactttttgttaaatgttaaatcgtttagcacggtaatctgagtgcacagtatgtcatttcattccgttggagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataagggtcatctttctgaaggattggttactaaatggtacagatctccacgtcttttactttctcctaataattatactaaagccattgacatgtgggctgcaggctgcatctttgctgaaatgctgactggtaaaaccctttttgcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagttgagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtcttttttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaaagaaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatacaaaaaaaaaaaa

SEQ ID NO: 814 - DNA, 1506 bp, Homo sapiens
aggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccatcaggcagtggctgttggaaagatttaagatttcacacctatgacatacatgggatagcacctgggccgccatgcactcaataaagaatgtatttt

SEQ ID NO: 815 - DNA, 2036 bp, Homo sapiens
ccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacaaa

SEQ ID NO: 816 - DNA, 1454 bp, Homo sapiens
accagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgatcacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatgtgattgtcatgtaaggcttaacacagtgggtggtgagttctgactaaaggttacctgttgtcgtgaaaaaaaaaaaaaa

SEQ ID NO: 817 - DNA, 1078 bp, Homo sapiens
ccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcactgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaa

SEQ ID NO: 818 - DNA, 762 bp, Homo sapiens
cggacctgcagccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataatt

SEQ ID NO: 819 - DNA, 925 bp, Homo sapiens
ttttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaaccgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatg

SEQ ID NO: 820 - DNA, 724 bp, Homo sapiens
ggaaaccagtgccccaggcggcgaaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctc

SEQ ID NO: 821 - DNA, 996 bp, Homo sapiens
agcagaggactttttagctgctcactggccccgcttgtctgaccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggcgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttaaaaaaaaaaaaaacaaaaaaaaaaaaaaaaaaaa

SEQ ID NO: 822 - DNA, 2828 bp, Homo sapiens
ttccggcggcacggacgagaagccgagcggcaaggggcggcgggatgccggggacaaggacaaagaactggagctgtctgaagaggataaacagcttcaagatgaactggtgatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatctgcaaaggtctgcctttatctcaccagttgtgtaaattacgtgcctgagcctgagaactcagccctactgcgttgtgccctgggtgtgttccgaaagtttagccgcttccctgaagctctgagattggcattgatgctcaatgacatggagttggtagaagactcttcctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatcttcggaagaaccccaattatgatctctaagtgaccaccaggggctctgaactgtagctgatgttatcagcaggccatgcatcctgctgccaagggtggacacggctgcagacttctgggggaattgtcgcctcctgctcttttgttactgagtgagataaggttgttcaataaagacttttatcccc

SEQ ID NO: 823 - DNA, 1602 bp, Homo sapiens
ggaaaaagggtaccggtgaccgctactgctgccggtgtttgcgtgtggcagggagccagtcctggcgagcggggtgtgtcgcgatgccggagctggcagtgcagaaggtggtggtccaccccctggtgctgctcagtgtggtggatcatttcaaccgaatcgtcaaggttggaaaccagaagcgtgtagttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagaccaagatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcggcacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttactttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttccctcctgtgagttggggaaatgatagtcaactcagccttcagattgtatgagaaaaatgaagagaagccaccaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaataac

SEQ ID NO: 824 - DNA, 4187 bp, Homo sapiens
aactcccgcctcgggacgcctcggggtcgggctccggctgcggctgctgctgcggcgcccgcgctccggtgcgtccgcctcctgtgcccgccgcggagcagtctgcggcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggagggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagacgaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggtgccctagtgcaacaggcattgctgaggtctgagcagggcctggcctttcctcctcttcctcaccctcatcctttgggaggctgacttggacccaaactgggcgactagggctttgagctgggcagtttcccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttgcccactggtccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 825 - DNA, 3314 bp, Homo sapiens
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggc

SEQ ID NO: 826 - DNA, 3215 bp, Homo sapiens
gcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccagacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctgctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcgacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatgtccttaagccaatatttactcatcaggtcattattttttacaatggccatggaataaaccatttttacaaaa

SEQ ID NO: 827 - DNA, 4315 bp, Homo sapiens
ggaaattgttcctcgtctgataagacaacagtggagaaaggacgcatgctgtttcttagggacacggctggcttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagaccttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcttggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggctaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgagtgtatatgtatgtgtgtatgggtgtgtgtttgtgtgagagacagagaaagagagagaattc

SEQ ID NO: 828 - DNA, 1837 bp, Homo sapiens
ctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgactgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggttgtgaaacagctattttattcccaatgcgttccaagaagatttttggaagcgtgcatccagtgagaccaatgaggcttgagtcttttagtgcctgcatttgggtcaaagccacagatgtattaaacaaaaccatcctgttttcctatggcacaaagaggaatccatatgaaatccagctgtatctcagctaccaatccatagtgtttgtggtgggtggagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaatgatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactaaaaaaaaaaaaaaa

SEQ ID NO: 829 - DNA, 424 bp, Homo sapiens
accagcccagcctttcagtgcaggctccagccctccacccccacccgagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctg

SEQ ID NO: 830 - DNA, 1928 bp, Homo sapiens
gagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacaaaaaaaaaaaaaaaaaaaaaa

SEQ ID NO: 831 - DNA, 3662 bp, Homo sapiens
aggtagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgccgatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataataaaaaaaaaaaaa

SEQ ID NO: 832 - DNA, 3423 bp, Homo sapiens
cggctcgctggtaccggcagtgccatggcggccttcagcaagtacttgacggcgcggaactcctcgctggctggtgccgcgttcctgctgctctgcctgctccacaagcggcgccgcgccctcggcctgcacggtaagaaaagtggaaaaccaccattacagaacaatgagaaagaggggaaaaaagagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaaaaactcagatatcctataaaaaaaaaaggaattc

SEQ ID NO: 833 - DNA, 846 bp, Homo sapiens
ccacgtccggggtgccgagccaactttcctgcgtccatgcagccccgccggcaacggctgcccgctccctggtccgggcccaggggcccgcgccccaccgccccgctgctcgcgctgctgctgttgctcgccccggtggcggcgcccgcggggtccgggggccccgacgaccctgggcagcctcaggatgctggggtcccgcgcaggctcctgcagcagaaggcgcgcgcggcgcttcacttcttcaacttccggtccggctcgcccagcgcgctgcgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtgggtaagaaaaacctgaaaattaacttgtgccacaagagttacaatcaaagtggtctccttagactgaattcatgtgaacttctaatttcatatcaagagttgtaatcacatttatttcaataaatatgtgagttcctgc

SEQ ID NO: 834 - DNA, 4307 bp, Homo sapiens
cctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcaaaaaaaaaaaaa

SEQ ID NO: 835 - DNA, 4290 bp, Homo sapiens
agaccttctgtccaccagctgagaaggacaagggcggaaggcagctgcacagagcagggccacggccttgcacacagtccagggagcttttgtgcaggagccaggcctccccctgggtccccatgatgagagaatgggttctgctcatgtccgtgctgctctgtggcctggctggccccacacacctgttccagccaagcctggtgctggacatggccaaggtcctcttggataactactgcttcccggagaacctgctgggcatgcaggaagccatccagcaggccatcaagagccatgagattctgagcatctcagacccgcagacgctggccagtgtgctgacagccggggtgcagagctccctgaacgatcctcgcctggtcatctcctatgagcccagcacccccgagcctcccccacaagtcccagcactcaccagcctctcagaagaggaactgcttgcctggctgcaaaggggcctccgccatgaggttctggagggtaatgtgggctacctgcgggtggacagcgtcccgggccaggaggtgctgagcatgatgggggagttcctggtggcccacgtgtgggggaatctcatgggcacctccgccttagtgctggatctccggcactgcacaggaggccaggtctctggcattccctacatcatctcctacctgcacccagggaacaccatcctgcacgtggacactatctacaaccgcccctccaacaccaccacggagatctggaccttgccccaggtcctgggagaaaggtacggtgccgacaaggatgtggtggtcctcaccagcagccagaccaggggcgtggccgaggacatcgcgcacatccttaagcagatgcgcagggccatcgtggtgggcgagcggactgggggaggggccctggacctccggaagctgaggataggcgagtctgacttcttcttcacggtgcccgtgtccaggtccctggggccccttggtggaggcagccagacgtgggagggcagcggggtgctgccctgtgtggggactccggccgagcaggccctggagaaagccctggccatcctcactctgcgcagcgcccttccaggggtagtccactgcctccaggaggtcctgaaggactactacacgctggtggaccgtgtgcccaccctgctgcagcacttggccagcatggacttctccacggtggtctccgaggaagatctggtcaccaagctcaatgccggcctgcaggctgcgtctgaggatcccaggctcctggtgcgagccatcgggcccacagaaactccttcttggcccgcgcccgacgctgcagccgaagactcaccaggggtggccccagagttgcctgaggacgaggctatccggcaagcactggtggactctgtgttccaggtgtcggtgctgccaggcaatgtgggctacctgcgcttcgatagttttgctgacgcctccgtcctgggtgtgttggccccatatgtcctgcgccaggtgtgggagccgctacaggacacggagcacctcatcatggacctgcgccacaaccctggagggccatcctctgctgtgcccctgctcctgtcctacttccagggccctgaggccggccccgtgcacctcttcaccacctatgatcgccgcaccaacatcacgcaggagcacttcagccacatggagctcccgggcccacgctacagcacccaacgtggggtgtatctgctcaccagccaccgcaccgccacggccgcggaggagttcgccttccttatgcagtcgctgggctgggccacactggtaggtgagatcaccgcgggcaacctgctgcacacccgcacggtgccgctgctggacacacccgaaggcagcctcgcgctcaccgtgccggtcctcaccttcatcgacaatcacggcgaggcctggctgggtggtggagtggtgcccgatgccatcgtgctggccgaggaggccctggacaaagcccaggaagtgctggagttccaccaaagcctgggggccttggtggagggcacagggcacctgctggaggcccactatgctcggccagaggtcgtggggcagaccagtgccctcctgcgggccaagctggcccagggcgcctaccgcacagctgtggacttggagtctctggcctctcagctcacagcagacctccaggaggtgtctggggaccaccgcttgctagtgttccacagccctggcgagctggtggtagaggaagcacccccaccaccccctgctgtcccctctccagaggagctcacctaccttattgaggccctgttcaagacagaggtgctgcccggccagctgggctacctgcgttttgacgccatggctgaactggagacagtgaaggccgtggggccacagctggtgcggctggtatggcaacagctggtggacacggctgcgctggtgatcgacctgcgctacaaccctggcagctactccacggccatcccgctgctctgctcctacttctttgaggcagagccccgccagcacctgtattctgtctttgacagggccacctcaaaagtcacggaggtgtggaccttgccccaggtcgccggccagcgctacggctcacacaaggacctctacatcctgatgagccacaccagtggctctgcggccgaggcctttgcacacaccatgcaggacctgcagcgggccacggtcattggggagcccacggccggaggcgcactctctgtgggcatctaccaggtgggcagcagccccttatatgcatccatgcccacccagatggccatgagtgccaccacaggcaaggcctgggacctggctggtgtggagcccgacatcactgtgcccatgagcgaagccctttccatagcccaggacatagtggctctgcgtgccaaggtgcccacggtgctgcagacggccgggaagctggtggctgataactatgcctctgccgagctgggggccaagatggccaccaaactgagcggtctgcagagccgctactccagggtgacctcagaagtggccctagccgagatcctgggggctgacctgcagatgctctccggagacccacacctgaaggcagcccatatccctgagaatgccaaggaccgcattcctggaattgtgcccatgcagatcccttcccctgaagtatttgaagagctgatcaagttttccttccacactaacgtgcttgaggacaacattggctacttgaggtttgacatgtttggggacggtgagctgctcacccaggtctccaggctgctggtggagcacatctggaagaagatcatgcacacggatgccatgatcatcgacatgaggttcaacatcggtggccccacatcctccattcccatcttgtgctcctacttctttgatgaaggccctccagttctgctggacaagatctacagccggcctgatgactctgtcagtgaactctggacacacgcccaggttgtaggtgaacgctatggctccaagaagagcatggtcattctgaccagcagtgtgacggccggcaccgcggaggagttcacctatatcatgaagaggctgggccgggccctggtcattggggaggtgaccagtgggggctgccagccaccacagacctaccacgtggatgacaccaacctctacctcactatccccacggcccgttctgtgggggcctcggatggcagctcctgggaaggggtgggggtgacaccccatgtggttgtccctgcagaagaggctctcgccagggccaaggagatgctccagcacaaccagctgagggtgaagcggagcccaggcctgcaggaccacctgtagggaagggccccataggcagagccccagggcagacagaacctctgggacacacaccaagggcactcctgcaggtggcccggcctgaggttcccaggagcagcaaaggggcctgctgagctctggttaggttacagctggaggtgtgtatatatacacacacacacgtgtatatacacatatatatgtgtatgtatatatatgtatatatatatggctttccaataaccacctaaattttaacaaaggttccttctaagtggtagaacttggggtggtatttttaccttccttcttcatactttgctctttttcttaaatactcattaatgtgcatatatcattattttcagatgcagctatcattattccaaaatacaaaataaagaagataaaataaattatatacccgagccattaaccacaa

SEQ ID NO: 836 - DNA, 2104 bp, Homo sapiens
gctgttgtcgctcgctcagcgtctccctctcggccgccctctcctcgggacgatggcgcgcggtggccgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaattacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagatttttatatttgccactgttagatagttggaaaggggaaattctgtttaagcgaaagtggtatcatcctaggtaagcttatttcagaacaagtctaatatatcagattctttcttttcgactttatactctgagttattacttactgtaagtggtgtatatgaaacctccatgcattttccagtatggatctgctaatatgcacagtaaatccatgtctttgtttgtttttctattaagaagcaatcaagaaagataatgtgaaaaagaaaggaatttagaggtagggaaaagatgaatgtcagacatgtgaagaactatagtaaaaatgataaaccacctaaatatccttgaacctaccttaaaatgccaatgaggtaggcctgatctttgaatagtggctaggatacaatgcatttcctcagtgatcactgattagaatgagttggtgggatccttgggaagccaaacggagcggggttctggatcatgtcccatccagtccagtgaatccccgacccgcagacctgccccccccgcaacagcttataccatggaatgaggacaaggtgatactctgagctgtggactgaactggcagacacaacctgtacagattgaaatttcaccttgtaaggaggaagtgaatgaaataaaggatccccctaagg

SEQ ID NO: 837 - DNA, 2022 bp, Homo sapiens
aattcggcacgagacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagcaactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttt

SEQ ID NO: 838 - DNA, 1446 bp, Homo sapiens
ctgccatttaggacaagctggatgatgatggtttgatagctccaggggttcgtgtataggagatgatgaatctgcttcatccagaatcacaatcttaaaaggcgggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgctggggtaataccagctgagaaaattgatggagtatttgctgcctgtcagagtggctcttttgacaaactagaagctgtggtcaaggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgatatatctggatggggggttttgtaaataatgaagttgtaataaaaataaaatgaccaaaagcaccg

SEQ ID NO: 839 - DNA, 1345 bp, Homo sapiens
aaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaagggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattg

SEQ ID NO: 840 - DNA, 1620 bp, Homo sapiens
gaattccgggtttgaaaaggagttctagggaagaagagagttagttagcacatcaatgggagcagggctcttaccccacgtggtgttacatatatattattttcatacatggtttctggctcataagttccttagcccttgctatagtcttttgtgttcggtcttaagggcaggactgtactcttccctcacctttctaattgtgcatcttaagaccttccccagagagggtggtgccctgtagttgtgggaaggaatgctggcatcatgaagcttccataaaaacccgagaaacgagcttctggatagctggacacatggaggtcctggagggtggagcccagggaggcatggaagctccacagcccttcccccataccttaccctatttcctctgtatcctttgtaatatcctttatgataaaccagcaaatgtgtgtaaatgtttccctaaggtctgtggccactccagcaaattaattgaacctaaagagggggtcgtgggaaccccaacttgaagccagtcagtcagaagttctggatgtccagacttcagactggtgtctgaaagggtggaggcagtcttggggaccgagcccccaatctatgggatctgacactatctccagtagtgttggaattgagtcaccagcgtgtccactggttagtgtgtgagaaactccctaccattggtcacagaagtcttcttctgtgttgatagttgtagtgtgacagcagaggaaaaacaaagtcagaaagagttttcccgaacacacccaatttctccattttactatccatttccacaaacactgactacaatagaagtataaaaattactccactgcatcattcagctttccatctctctcagacaccaagctgcagatccaggtcactttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagccggaattc

SEQ ID NO: 841 - DNA, 1147 bp, Homo sapiens
ggcacgagcgcgcccacgctgggccgggagtcgaaatgcttcccggtgccgggagtgagcgatgagctggtttctgttcctggcccacagagtcgccttggccgccttgccctgccgccgcggctctcgcgggttcgggatgttctatgccgtgaggaggggccgcaagaccggggtctttctgacctggaatgagtgcagagcacaggtggaccggtttcctgctgccagatttaagaagtttgccacagaggatgaggcctgggcctttgtcaggaaatctgcaagcccggaagtttcagaagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggagacttcgtcgtcgtctacactgatggctgctgctccagtaatgggcgtagaaggccgcgagcaggaatcggcgtttactgggggccaggccatcctttaaatgtaggcattagacttcctgggcggcagacaaaccaaagagcggaaattcatgcagcctgcaaagccattgaacaagcaaagactcaaaacatcaataaactggttctgtatacagacagtatgtttacgataaatggtataactaactgggttcaaggttggaagaaaaatgggtggaagacaagtgcagggaaagaggtgatcaacaaagaggactttgtggcactggagaggcttacccaggggatggacattcagtggatgcatgttcctggtcattcgggatttataggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattgggaaaaaaaaaaaaaaaaa

SEQ ID NO: 842 - DNA, 996 bp, Homo sapiens
gaattccggcccccctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagtctctcagatcctatcctgtggaatttagttattatgtgtatttatgtagtatttcaaacatttcaaaatgctttcatctatgtttatcacattttaataccacagacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttccggaattc

SEQ ID NO: 843 - DNA, 2397 bp, Homo sapiens
ttagctaggcatggtggcacatgcctgtaatcccagctactcgggaggctgaggcaggagaattgcttgaacccgggaggcagaggttgcagccggctgagatggcgccatcacactccagcctgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggatacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaagaaaactttaaaaaaactcccattaaaaacaaaacatctttgtgttgtgaacaaaggaattttcaatatttgattggtattctgttctgaagtctaggatatttttcagcctataaagccccctgttttatgcccttctaattctgatgtttgggtattgtgtgagtgcatgtgtttttttttttttttttttaaagcgtgtgtgaacaaatggaaataaagcagggactgtg

SEQ ID NO: 844 - DNA, 512 bp, Homo sapiens
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 845 - DNA, 424 bp, Homo sapiens
  Modified_base 50: n = a,c,g, or t
atgtctcttgtcagctgtctttcagaagacctggtggggnaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggctggcagcccacaaaaaaagccatgaagaaagccacaaagagtagctgagttactgcccagaggctgggcccctgacatgtacctgcagaataataaagtcatcaatacctcaaaaaaaaaaaaaaaaaaaaa

SEQ ID NO: 846 - DNA, 576 bp, Homo sapiens
aaacactctgtgtggctcctcggctttgggacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccatggccacagtcatggtggccacggccacaggccactaatcaggaggccaggccaccctgcctctacccaaccagggccccggggcctgttatgtcaaactgtcttggctgtggggctaggggctggggccaaataaagtctcttcctccaa

SEQ ID NO: 847 - DNA, 649 bp, Homo sapiens
agaatacactcacaagccactccgctgctcgcctctccgccccgcgtccagctcgcccagctcgcccagcgtccgccgcgcctcgccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttcc

SEQ ID NO: 848 - DNA, 1407 bp, Homo sapiens
cgaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatcctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccttgcccatcccaccacccggcctttccctgcgccgtgcccaccctcctccggaatcgcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgaaaaaaaaaaaaaaaa

SEQ ID NO: 849 - DNA, 739 bp, Homo sapiens
ctaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaaaaaaaaaaaa

SEQ ID NO: 850 - DNA, 776 bp, Homo sapiens
aaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctagagctgagtgcctgaggggtccagaagcttcgaggcccagcgacctcggtgggccagtggggaggagcaggagcctgagccttgggaaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcagcctgtgtaggcagtcatggcaccaaagccaccagactgacaaatgtgtatcggatgcttttgttcagggctgtgatcggcctggggaaataataaagcacgctcttttaaaaggt

SEQ ID NO: 851 - DNA, 696 bp, Homo sapiens
ttccccccccccccccccccccccgcccgagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcctatggggatggtccactgtcactgtttctctgctgttgcaaatacatggataacacatttgattctgtgtgttttccataataaaactttaaaataaaatgcagacagtta

SEQ ID NO: 852 - DNA, 1160 bp, Homo sapiens
cctccgacagcctctccacaggtaccatgaaggtctccgcggcacgcctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctgaccacgacgagcagcagttacaaaaaccttccccaggctggacgtggtggctcagccttgtaatcccagcactttgggaggccaaggtgggtggatcacttgaggtcaggagttcgagacagcctggccaacatgatgaaaccccatgtgtactaaaaatacaaaaaattagccgggcgtggtagcgggcgcctgtagtcccagctactcgggaggctgaggcaggagaatggcgtgaacccgggagcggagcttgcagtgagccgagatcgcgccactgcactccagcctgggcgacagagcgagactccgtctcaaaaaaaaaaaaaaaaaaaaaaaaaatacaaaaattagccgcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgcaagggctctgtgacaaggaaggaagtcagcatgcctctagaggcaaggaagggaggaacactgcactcttaagcttccgccgtctcaacccctcacaggagcttactggcaaacatgaaaaatcgggg

SEQ ID NO: 853 - DNA, 803 bp, Homo sapiens
ccggcacgagaggagttgtgagtttccaagccccagctcactctgaccacttctctgcctgcccagcatcatgaagggccttgcagctgccctccttgtcctcgtctgcaccatggccctctgctcctgtgcacaagttggtaccaacaaagagctctgctgcctcgtctatacctcctggcagattccacaaaagttcatagttgactattctgaaaccagcccccagtgccccaagccaggtgtcatcctcctaaccaagagaggccggcagatctgtgctgaccccaataagaagtgggtccagaaatacatcagcgacctgaagctgaatgcctgaggggcctggaagctgcgagggcccagtgaacttggtgggcccaggagggaacaggagcctgagccagggcaatggccctgccaccctggaggccacctcttctaagagtcccatctgctatgcccagccacattaactaactttaatcttagtttatgcatcatatttcattttgaaattgatttctattgttgagctgcattatgaaattagtattttctctgacatctcatgacattgtctttatcatcctttcccctttcccttcaactcttcgtacattcaatgcatggatcaatcagtgtgattagctttctcagcagacattgtgccatatgtatcaaatgacaaatctttattgaatggttttgctcagcaccaccttttaatatattggcagtacttattatataaaaggtaaaccagcattctcactgtgaaaaaaaaaaaaaaaaaaaaaaaa

SEQ ID NO: 854 - DNA, 3310 bp, Homo sapiens
ggcacgagggcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccaccttccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctgggcactgcttccagtgaggctctgcccttggttaggsattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcargggagtgagttgatagcacagaccctgccctgtgggcccccaaatggaaatgggcagagcagagaccatccctgaaggccccgcccaggcttagtcactgagacagcccgggctctgcttcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccaggggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaaaacgctgtgctgccctgcccaccctggcctctgcactcccctgctgggtgtggcgcagcatattcaggaagctcagggccctggctcaggtggggtcactctggcagctcagagagggtgggagtgggtccaatgcactttgttctggctcttccaggctgggagagcctttcaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtgaaaaaaaaaaaaaaaaaaaaaaa

SEQ ID NO: 855 - DNA, 2402 bp, Homo sapiens
  Modified_base 2148: n = a,c,g, or t
ggagaggtgcgggccgaatccgagccgagcgagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagctggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtgggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatctgcgggtggggcttggggctcacacacctgtagcacttactggtaggaccaagcatcttgggggggtggccgctgagtggcagggacaggagtcactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacncccgtcctgcctgtgcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagt

SEQ ID NO: 856 - DNA, 2613 bp, Homo sapiens
gcgcgccttctccagtccgcggtgccatggcccccgcccgtctgttcgcgctgctgctgctcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtactttctaaaaaaaaaaaaaaaaaaa

SEQ ID NO: 857 - DNA, 4469 bp, Homo sapiens
cctgcagcctccggagtcagtgccgcgcgcccgccgccccgcgccttcctgctcgccgcacctccgggagccggggcgcacccagcccgcagcgccgcctccccgcccgcgccgcctccgaccgcaggccgagggccgccactggccggggggaccgggcagcagcttgcggccgcggagccgggcaacgctggggactgcgccttttgtccccggaggtccctggaagtttgcggcaggacgcgcgcggggaggcggcggaggcagccccgacgtcgcggagaacagggcgcagagccggcatgggcatcgggcgcagcgaggggggccgccgcggggccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccgggacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttcccggagggggacgtctgcatcgccatgacgccgcccaatgccaccgaagcctccaagccccaaggcacaacggtgtgtcctccctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgcccgggaacccgtggtcacacacacgcactgccctgtcagtagtggacattgtaatccagtcggcttgttcttgcagcattcccgctccctttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatctaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgttcccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggagaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacataagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaatgaaaaaaaaaaa

SEQ ID NO: 858 - DNA, 1763 bp, Homo sapiens
tagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaaagttcttgcaggtaatgtttatgtatagttaaacgttgtaatttcttatcgtaattataacattcccattctttgtagatgaaactctacatatgaaccacagattttctgagcttctaaatgtagcctttcattgcacatttcagtgatcagaatagatatccttttacacgcacaaaagcaatagattcattcagtggacaagttccttgtttaactacacagctatgatggaatcatatatccaagttccttgcctcagtgaaatatgcatatgtatatcatgaagtgggatgccaagtaagcttaaaatgcattctctagcaaagagattagacttttaaataactcttataaaacaggttggcgatcatttcccaagattggtttcccttgagtttttgttaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttgatgagattcaaacttgatgctatgctttaaaataaactcagtacttttagaaacataaaaaaaaaaaaaaaaaaaaaaaaaa

SEQ ID NO: 859 - DNA, 2117 bp, Homo sapiens
ggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatctataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctgataaaaaaaaaaaaa

SEQ ID NO: 860 - DNA, 5198 bp, Homo sapiens
ctcacttaaacacgtagttcccgcgaccccaacgtcccagaggcggggccggagtcggcggtggcgctccttggagccggctcccgctcctaccctgcaaacagacctcagctccgcggaagttgcgagacggggtttcaccatgttggtcgggctggtctggaaatcctgacttcaggtgatccacccgcctcggcctcccaaaatgctgggattacaagcgtgagccaccgcccctgacatgagccattgacttttaaagcaggagaataatttggatcagatttatatggaaacactcttctagcagcattatggggacttttccataagtctggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaacgagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaactcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacccgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcccagctatactgtatatttaagaaggtccagcatgttgcatctctgcattatcctatatcataaaagaagcataagttatcatggtgttgggtaaattagcgaaatcaaccgcttcctaagtttaagggaaaagttatttttaaaaacaacttaataaaaacttacactcttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttt

SEQ ID NO: 861 - DNA, 2218 bp, Homo sapiens
cttctctctccattcagtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatccaaattattttgttagtggaaaatggaattgcttctgtgtagtcaataaaatgaacctgatcacttttc

SEQ ID NO: 862 - DNA, 2578 bp, Homo sapiens
tctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaaacagcagaatctccggaccagaaagacacagaaggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgttttt

SEQ ID NO: 863 - DNA, 594 bp, Homo sapiens
gtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcac

SEQ ID NO: 864 - DNA, 399 bp, Homo sapiens
atgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttga

SEQ ID NO: 865 - DNA, 2767 bp, Homo sapiens
gcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagtgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggagggctaggactgacccttgtggtgtttttttgggtggtggctggaaacagcccctctcccacgtgggagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgc

SEQ ID NO: 866 - DNA, 1054 bp, Homo sapiens
gaattccgcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagagaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactctctatgctaaaaaaaaaaaaaaggaattc

SEQ ID NO: 867 - DNA, 455 bp, Homo sapiens
tagacgccgggcctacagcgggaggctgaggaaagccgtgcgttgcgttccaaggacatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgtttactatgatgtaaaaattaggtcatgtacattttcatattagactttttgttaaataaacttttgtaatagtcaaaaaaaaaaaaaaaaa

SEQ ID NO: 868 - DNA, 1974 bp, Homo sapiens
  Modified_base 1733, 1786, 1831: n = a,c,g, or t
cgggatcaatttgatttgacagtcggtataactgatcctgagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttytcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccntgtccccacgaccaactgtccccagttactctaaccgttatttcatttagctnccatatatattttcttacctaagagaatagtttcctgctttaagnaaaagacctacaataggtggtggaattatgggatggggtggagtattgatataaatatataaatacaaatgtatatttttcaggatgtggtttaggaactgggaataacgttttcatggcaccatcaggagtaacagaaaacc

SEQ ID NO: 869 - DNA, 1984 bp, Homo sapiens
ggatccagagatttagattttttataagctttcctgccaccgaaacgggtgtttgggacctcacgaggccctgttcattcttcgtcgctgcgctccccactctgtactggatgcatttactgacgttgttgtctccgtccccagagtatgaacccccaaggtgactcatgcagctgtgggtgcccggcatacagcatggtgactggaatggatgagcacccaataaacatttgttgcaggaatgcaggaggacgggcaggccagcaagcaggctgcctggtttttcccacatgggcttttctgggaaagaagagcttctatttttggaaagggctgctatgattgagaaaagttcatggcagcaaaaaaaggacagacgtcgggagggaaacactcctagttctcccagacaacacattttttaaaaagactccttcatctctttaataataacggtaacgacaatgacaatgatgattacttatgagtgcggctagtgccagccactgtgttgtcactgggcgagtaatgatctcattggatcttcacggtgggcgtgcggggctccagggacagcctgcgttcctgggctggctgggtgcagctctcttttcaggagagaaagctctcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcacgctccacgccgcctgccaggtgcagccgtcggccacgctggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccttccactctgaggtctcaccttcgcctctgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggtacctttccacccagaccctccttccccaccccataagccctgagactcccgcctttgacctgacgatcttcccccttcccgccttcaggttcctcctaggcgctcagaggccgctctggggggttgcctcgagtccccccacccctccccacccaccaccgctcccgcggcaagccagcccgtgcaacggaagccaggccaactgccccgcgtcttcagctgtttcgcatccaccgccaccccactgagagctgctcctttgggggaatgtttggcaacctttgtgttacagattaaaaattcagcaattca

SEQ ID NO: 870 - DNA, 1808 bp, Homo sapiens
gcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaaca

SEQ ID NO: 871 - DNA, 1998 bp, Homo sapiens
ggggtgggagggggagggggacctccgcacgagacccagcggcccgggttggagcgtccagccctgcaacggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatattgaaaggcgcccgctgctcgctctttctctcggagggtgcagagctgggttccttgggaggaagttgtagtggtgatgatgatgatgatgataatgatgatgatgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggcgcggcggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaaggg

SEQ ID NO: 872 - DNA, 2133 bp, Homo sapiens
cgggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaatccaccaaccagaacgtggtttgcctgaggctgtaactgagagaaagattctggggctgtcttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctcccctttgttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaagtaatgacttagaaactgaaaaaaaaaaaaaaaaaaaaaaaaaaaaaa

SEQ ID NO: 873 - DNA, 1444 bp, Homo sapiens
ccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccccgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtccctctgggatttctttgtcatgtacagactccctgggatcctcatgttttgggtgacaggacctatggaccactatactcggggaggcagggtagcagtgcttccagagtcccaagagcttctctgggattttcttgtgatatctgattccccagtgaggcctgggacctttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctcc

SEQ ID NO: 874 - DNA, 721 bp, Homo sapiens
tcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatc

SEQ ID NO: 875 - DNA, 4326 bp, Homo sapiens
atataaaatagtattccaaataagtacattttatagcaaaattatgcatttttcctaagactttcatcaccaatatcgccttataccctgcttttgttgggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagtctcccaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtctcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataaccta

SEQ ID NO: 876 - DNA, 3285 bp, Homo sapiens
ctagaattcagcggccgctgaattctagacccggatgaagagtaacgccattaccgcccgagccgccgagagccttagccgacggaaactggacactggaccggcagcgccatgagactcctcccccgcttgctgctgcttctcttactcgtgttccctgccactgtcttgttccgaggcggccccagaggctcgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggaccaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccagtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtaattgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcattttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgtaaaaaaaaaaaaaaaaaaaaa

SEQ ID NO: 877 - DNA, 2839 bp, Homo sapiens
gaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaaccaaaaaaaggaattc

SEQ ID NO: 878 - DNA, 2963 bp, Homo sapiens
gttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtacatctggtggtgtgcattagatgtgagggctatgttgacatggcatcacctccaaagacctgacctgcctaaagactgatgacaggccatccttcctgctgttctaggtactggcctgggtgacagagcaggacatgagacatagatacagtggggaggagaagtggggaaaggtggagcagagagttcttacttattgaagattatacagccctttcggttatgaagtccctgcttgaaggcaatggacctggggaagagactatcacaaaaagtctccattttcattttacatcctctctattggaggcagcacttttccctcatgctgtcctataggactccactttgaaggttgtgcctacgttgcagggaactaggaacatggaggggaaccaacaacagcatcttagaagaaatgtagccaaattggagtccattcttctttagggcagtatatgaaatcctagcagatgtaaaatggaaaagaatcctaatgcttcttccttcagaaagtagaggaactaggggcccaattagcatcatctaggggaatctctattactctgtacttatactaatgtttacaagaatgcaatatactgtgatgccttcctactcaagcctcctagcattcaaacttccatcctattagtcattaacgtggttaaacttcaattcacaatcaccttggaatcaatgtcagtttgatttattttgttacagagcaataaaatcattagaacaatggtttttaaaagacttaagtggatgcatcctatgcatgtaagcattatttcccaaaccaaagcatcattcatctccatttatttcttttgttcccgctcagtgtgaagttgggaactgagaggggatggctgctggtttcacagaagtttggatgccttactcttatcttaaagccagcatccagaatttcctccctctctgatgccacatgcaaaaccaggtgtacgatgtcaagatggattctttgagagccagggtagatcatatgactgcctttctgtaaaattggatgcctagtacaaatgctctttgcctctaattcagtattccatttaataaaaacaatacagtggctggaaaggagcatcag

SEQ ID NO: 879 - DNA, 2588 bp, Homo sapiens
gctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacag

SEQ ID NO: 880 - DNA, 3698 bp, Homo sapiens
tggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgccggagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttggagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccagcaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaaa

SEQ ID NO: 881 - DNA, 2033 bp, Homo sapiens
gaattccgggactgagctcttgaagacttgggtccttggtcgcaggtggagcgacgggtctcactccattgcccaggccagagtgcgggatatttgataagaaacttcagtgaaggccgggcgcggtgctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcgcacctgaaaataatcctgaggaggaactggcatcaaaacagaaaaatgaagaatcaaaaagaggcagtggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctaacttatataacagaattgcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatattttgtttttactcagcaggtgtgccttaacctccctattcagaaagctccacatcaataaacatgacactctgaagtgaaagtagccacgagaattgtgctacttatactggaacataatctggaggcaaggttcgactgcagtcgaaccttgcctccagattatgaaccagtataagtagcacaattctcgtggctactttcacttcagagtgtcatgtttattgatgtggagctttctgaatagggaggttaaggcacacctgctgagtaaaacaaatatttcttgtgtagcgttcttaggaatctggtgtctgtccggccccggtaggcctgttgggtttctagtcctccttaccatcatctccatatgagagtgtgaaaataggaacacgtgctctacctccatttagggatttgcttgggatacagaagaggccatgtgtctcagagctgttaagggcttatttttttaaaacattggagtcatagcatgtgtgtaaactttaaatatgcaggccttcgtggctcgag

SEQ ID NO: 882 - DNA, 3899 bp, Homo sapiens
ctgacgcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtgagagccaaagaaacaaagatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggaaaaaaaaa

SEQ ID NO: 883 - DNA, 1019 bp, Homo sapiens
cggggccgggtgcgatggcggcggtggctgcgttgcagctggggctgcgggcggcggggctgggacgggccccggccagcgccgcctggaggagcgtcctcagggtctccccgcgcccaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctacctt

SEQ ID NO: 884 - DNA, 2541 bp, Homo sapiens
gaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaaaaaaaaa

SEQ ID NO: 885 - DNA, 1448 bp, Homo sapiens
tcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagttgtagctcgagtcccaaaccttacggccaagtttcttctagtatgatggaaagtttcttttttctttgctctgaataaaactgaactgtgggttctctataagtggcattttgggctttcctcccttttttgtaaagcaatgtctgcctagtttattgtccaagttaactttaggtgaccttttaaaagttggcattgaaaataaaacaacttgcaaaaaagttttctggaatagaattaacaaaatattatctttatcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaagtaagttatat

SEQ ID NO: 886 - DNA, 2910 bp, Homo sapiens
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagcggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaaatgacagagacccagatctcatggaaactggcaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatgactccgtcgatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagcttctgggcagcttgagagggcaaacccaaaacctcatgacagccagagcctgtctttcagcattcagtcgcctgggaagctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtcgtcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 887 - DNA, 1670 bp, Homo sapiens
ggcgggagggccgcagctccggcgccgcgccgtcccgccagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacggagagggcgtgtggagcccggatattgagcagagtttccaggaggccctcgccatctacccgccctgtggcaggcgcaaaatcatcctgtcggacgagggcaagatgtatggtcgaaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatgcgcctcgcccggggccccggccgcccagcagtctcagggttttggcaaggagctttgccaggccaagccgaaacgtcccatgatgtgaagcctttctctcagcaaacctatgctgtccagcctccgctgcctctgccagggtttgagtctcctgcagggcccgccccatcgccctctgcgcccccggcacccccatggcagggccgcaggcgtggcagctccaagctctggatgttggagttctctgccttcctggagcagcagcaggacccggacacgtacaacaagcacctgttcgtgcacattggccagtccagcccaagctacctgcgcccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggccagccccctgaagtgccaagagagctgagaggagcagttgtgactctacccaggaacaaactgtgcctgaacctgaggtgcccaaccccaaataaacccaagatgctgtgtattttcagaggaaaa

SEQ ID NO: 888 - DNA, 2600 bp, Homo sapiens
ggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacagcaatgatctttacctgcttcaccctcagtgcactctatgccaggcgccgtagctacctctttctgggaggtatcttgatgtcagccctgagcttgttgcttttgtcttccctggggaatgttttctttggatccatttggcctttccaggcaaacctgtatgtgggactggtggtcatgtgtggcttcgtccttgttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccgccccttgcctgaccctcagggagtcagcctgcttccatccatgggtgggaagacttcagcacaaaggaaagactaattcttgtcaggcatttttgaaaaggctgattatgtgtatcaaggtacagctacgtaggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaaaaaaaaaaaaaaaaaaaaaaaa

SEQ ID NO: 889 - DNA, 540 bp, Homo sapiens
atccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacggggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaaaaaaaaaaaaaaaaaaaaaaaaaaaaaaaaaaaaaaaaaaaaaaaaaa

SEQ ID NO: 890 - DNA, 398 bp, Homo sapiens
gatgctggggctggtcctggccttgctgtcctccagctctgctgaggagtacgtgggcctgtctgcaaaccagtgtgccgtgccggccaaggacagggtggactgcggctacccccatgtcacccccaaggagtgcaacaaccggggctgctgctttgactccaggatccctggagtgccttggtgtttcaagcccctgactaggaagacagaatgcaccttctgaggcacctccagctgcccctgggatgcaggctgagcacccttgcccggctgtgattgctgccaggcactgttcatctcagtttttctgtccctttgctcccggcaagctttctgctgaaagttcatatctggagcctgatgtcttaacgaataaaggtcccatgctccacccg

SEQ ID NO: 891 - DNA, 5010 bp, Homo sapiens
ggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggttcgcttactttgagtgatcctccaacttcatttgatgctaaataggagataccaggttgaaagacctctccaaatgagatctaagcctttccataaggaatgtagcaggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccatttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagcagcatacatttataatgtttgctattgacaagtcattttaatttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcatataaacgtgtagtacagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagtagggccttttggaggtaaaggtata

SEQ ID NO: 892 - DNA, 4119 bp, Homo sapiens
ctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagactctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgacatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttattttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaatggacactggtttttagacctctatcaatcagtagttagcatccaagagactttgcagaggcgtaggaatgaggctggacagatggcggaacgagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggctccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttcttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaacctttttttcctaaaaaaaaaaaaaaaaaaaaaaaaaaaaaaaaa

SEQ ID NO: 893 - DNA, 2574 bp, Homo sapiens
cctgtttagacacatggacaacaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcatttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggtcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtg

SEQ ID NO: 894 - DNA, 3074 bp, Homo sapiens
gaattccggggagcaggaagagccaacatgctggccccgcgcggagccgccgtcctcctgctgcacctggtcctgcagcggtggctagcggcaggcgcccaggccaccccccaggtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaagcaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtcgccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagtggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtgggcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaaaaaaaaaaaaaaaaa

SEQ ID NO: 895 - DNA, 1075 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatccc

SEQ ID NO: 896 - DNA, 1421 bp, Homo sapiens
acttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcatggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcaagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaatt

SEQ ID NO: 897 - DNA, 2600 bp, Homo sapiens
ggatccaaaggagacctatagtgactcccaggagctcttagtgaccaagtgaaggtacctgtggggctcattgtgcccattgctctttcactgctttcaactggtagttgtgggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaacgtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgaagagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgagga

SEQ ID NO: 898 - DNA, 899 bp, Homo sapiens
aagattcacagcatctcagacgcagcctaggccgcaccaggatgtcggacaccgaggagcaggaatatgaggaggagcagccggaagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacaaaaaaaaaaaaaaaaaaa

SEQ ID NO: 899 - DNA, 3866 bp, Homo sapiens
ggaattcctttttttttttttttgagatggagtttcactcttgttggccaggctggagtgcaatggcacaatctcagcttactgcaacctccgcctcccgggttcaagcgattctcctgcctcagcctctcaagtagctgggattacaggcatgtgccaccacccctggctaactaatttcttttctatttagtagagatggggtttcaccatgttggtcaggctggtcttgaactcctgacctcaggtgatccacttgccttggcctcccaaagtgctaggattacagccgtgaaactgtgcctggctgattctttttttgttgttggatttttgaaacagggtctcccttggtcgcccaggctggagtgcagtggtgcgatcttggctcactataacctccacctcctggtttcaagtgatcctcccactttagcctcctgagtagctgtgattacaggcgtgcaccaccacacccggctaatttttgtatttttattagagacagggtttcaccatgttggccaggctgttctcaaactcctggactcaagggatccgcctgcctccacttcccaaagtcccgagattacaggtgtgagtcaccatgcctgaccttataattcttaagtcattttttctggtccatttcttccttagggtcctcacaacaaatctgcattaggcggtacaataatccttaacttcatgattcacaaaaggaagatgaagtgattcatgatttagaaaggggaagtagtaagcccactgcacactcctggatgatgatcctaaatccagatacagtaaaaatggggtatgggaaggtagaatacaaaatttggtttaaattaattatctaaatatctaaaaacatttttggatacattgttgatgtgaatgtaagactgtacagacttcctagaaaacagtttgggttccatcttttcatttccccagtgcagttttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaagctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataggaggtataaaatatattggactgttatactcttgaatccctgtggaaatctacatttgaagacaacatcactctgaagtgttatcagcaaaaaaaattcagtgagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatga

SEQ ID NO: 900 - DNA, 501 bp, Homo sapiens
gaattcgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaaccctttctttcattccctctctgaaaagtattccaacgtgatattccttgaagtagatgtggatgactgtcaggatgttgcttcagagtgtgaagtcaaatgcacgccaacattccagttttttaagaagggacaaaaggtgggtgaattttctggagccaataaggaaaagcttgaagccaccattaatgaattagtctaatcatgttttctgaaaacataaccagccattggctatttaaacttgtatttttttatttacaaaatataaatatgaagacataaccagttgccatctgcgtgacaataaacattatgctaa

SEQ ID NO: 901 - DNA, 604 bp, Homo sapiens
ccacgcgtccgcgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaaaaaaaaaaaaaaaaaaaaaaaaaaaaaaa

SEQ ID NO: 902 - DNA, 1637 bp, Homo sapiens
gaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggtaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaa

SEQ ID NO: 903 - DNA, 2950 bp, Homo sapiens
gcggcccgtaggaaggtgctgtccgatcgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgatttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctgggctaattttttgtatttttagtagagacagggtttcaccatgtgagccaggatggtctcaatctcctgaccttgtgaaccacccgtctcggcctcccaaagtgctgggattacaggtgtgagccaccacgcctgggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagatttttttttttaatcatgaagagaaaattagtagcatttctttctctccccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaaaa

SEQ ID NO: 904 - DNA, 1894 bp, Homo sapiens
ggctgaggacccgagggaggacacggttaaagcatcgctatcaactgcgtaacccagagagccctccttagccaacacgctaactccgaagcctccccttacgcccccgaaccaccgaaggcggcgacacctgattcagcgcacaaacacaggtcccttctgtcccggatacaattacgcggcagacacacactcagactcgcgcggggcagccaagagacgagctatgaagtcttacactccatatttcattctcctgtggagtgctgttgggatagcgaaggctgctaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccaggaatctttaacagtaccacctcagatgctttcctacagtccaagatgcggaatattttctctgggagattgccagcaatcgaactgtttgacatactggatcactatactaagaactgtgacatgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccggagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcgtgagccatggtggtttgaacagtatttttgaaactatgtatcatggtgtgcctgtagtgggaattccagtctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccgacagcccaggtgatagaaataaattggttcactcattg

SEQ ID NO: 905 - DNA, 3221 bp, Homo sapiens
ggcacgagccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaact

SEQ ID NO: 906 - DNA, 649 bp, Homo sapiens
tcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagcgtttcgggaaccagatctctcaccagg

SEQ ID NO: 907 - DNA, 1851 bp, Homo sapiens
gggcgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctaggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacattcctgattaagacggttgaaactagagatggacaggttatcaacgaaacttctcagcatcacgatgaccttgaataaaaattgcacacactcagtggcaggcgatatattacccaggcaagaataaaaaagaaatcccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaactcca

SEQ ID NO: 908 - DNA, 4114 bp, Homo sapiens
attaattctggctccacttgttgctcggcccaggttggggagaggacggagggtggccgcagcgggttcctgagtgaattacccaggagggactgagcacagcaccaactagagaggggtcagggggtgcgggactcgagcgagcaggaaggaggcagcgcctggcaccagggctttgactcaacagaattgagacacgtttgtaatcgctggcgtgccccgcgcacaggatcccagcgaaaatcagatttcctggtgaggttgcgtgggtggattaatttggaaaaagaaactgcctatatcttgccatcaaaaaactcacggaggagaagcgcagtcaatcaacagtaaacttaagagacccccgatgctcccctggtttaacttgtatgcttgaaaattatctgagagggaataaacatcttttccttcttccctctccagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgacggtggaactgcagcactgtggataacacctctgtttttggcagggtgatgcagataggcagccgcgagacggccttcacatacgccgtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtgggtacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattctggtttttggtttttagaaatattttttatttttccccaagaattgcaaccggaaccattttttttcctgttaccatctaagaactctgtggtttattattaatattataattattatttggcaataatgggggtgggaaccacgaaaaatatttattttgtggatctttgaaaaggtaatacaagacttcttttggatagtatagaatgaagggggaaataacacataccctaacttagctgtgtgggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattgggattccagatttgtaaaaagacccccaatgattctggacactagattttttgtttggggaggttggcttgaacataaatgaaatatcctgtattttcttagggatacttggttagtaaattataatagtagaaataatacatgaatcccattcacaggtttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagcttactctggggttatctctctgtctagagcattgttgtccttcactgcagtccagttgggattattccaaaagttttttgagtcttgagcttgggctgtggccccgctgtgatcataccctgagcacgacgaagcaacctcgtttctgaggaagaagcttgagttctgactcactgaaatgcgtgttgggttgaagatatctttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagctttttttttttttttttttttttaataaggacacctctttccaaacaggccatcaaatatgttcttatctcagacttacgttgttttaaaagtttggaaagatacacatcttttcatacccccccttaggaggttgggctttcatatcacctcagccaactgtggctcttaatttattgcataatgatatccacatcagccaactgtggctctttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttattccaaatggaag

SEQ ID NO: 909 - DNA, 3138 bp, Homo sapiens
cgggtgccatgcagctttctctaatttgctctcagttcctggctatgaattgctaaactatcagtctcgcgctcaccgcccggctgaggaggtgaaagtttctccccaggaagataaaccgcaaaagacatatattgtgcatgatttgcgccttttctttggctttttctttctttcttcacccccccacccacttttttttttttttttttcaaaaagcagagagggaaaaacggagagtgaaggagcgaggaggcgagcgtgagagaaaggagagagagagaaaagaaagggcgaggggctagtggaggaaggaaggaggggcggctgcgcgaggcggagagagggcgaagcagtcgcggcactggcgctcacattcctctatgctacaaatccaggaggaagtttttttttagggggctgagatgctccatgcctttaaaagggcagccttgacgcgcggccctctcggcagagactgagcggcgagaaagtgcgagccgggccggcagaatctgcctggcgggcgctggagcctgcgttactcgcggcccgcagccgtccggctactttgcgtttggcccggccagcgccgcgcggcgcgcgcgcgccattgcctgcaggctaggacttcgcgaggtgggtcgactcaccctccctcctcctcttcttcctcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacagccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctcttccccgggcttcacgagcaggctgccggccacgcgtcgcctaacgtggtcaacgggcagatgaggctcggcttctcgggggacatgtacccgcgaccggagcagtacggccaggtgaccagcccgcgttcggagcactatgctgcgccgcagctgcacggctacgggcccatgaacgtgaacatggccgcgcatcacggcgccggcgccttcttccgctacatgcgccaacccatcaagcaagagctcatctgcaagtggatcgagcccgagcagctggccaaccccaaaaagtcgtgcaacaaaactttcagcaccatgcacgagctagttacgcacgtcaccgtggagcacgtaggtggcccggagcagagtaatcacatctgcttctgggaggagtgtccgcgcgagggcaagcccttcaaagccaaatacaaactggttaaccacatccgcgtgcacacgggcgagaagccctttccctgccccttccctggctgtggcaaggtcttcgcgcgctccgagaatttaaagatccacaaaaggacgcacacaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttccgtgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagacttgatcacacacgtatacacaacattactgaaagaaccctgcgaatcaaaacaacccccacacagaccccgcaatcctcttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctcaaa

SEQ ID NO: 910 - DNA, 3839 bp, Homo sapiens
caggtctcgacttcactgctctgtgtcctctgctccaggaggcccagcctgtgtggccctgtgacctgcaggtattggaagagccacagctaagatgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtattgctctctctaagccagacctgattacttatctggagcaaggaaaagagccctggaatatgaagcaacatgagatggtggatgaacccacaggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacataccggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaaggatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaccctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtgggaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgttgcaaagcctttaaccagtcttcaatccttactaaccataagaaaattcatactatcacacctgtaatcccactactttgggaggccgaggcgggcggatcacgaggtcaggagatggagaccatcctggctaacacagtgaaaccccttctctactaaaaaatacaaaaaactagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaa

SEQ ID NO: 911 - DNA, 929 bp, Homo sapiens
caaacaaggcccacactggacagggcagctgctgggttgctactctcgcctccgccatgattccgcccgcagactcttttgctcaagtacgacaccccagtgctggtgagccggaacacggagaaacggagccccaaggtcggctactgaaagtcagcccccagcagcctggaccttcaggttcagccccacagccacccaagaccaagctcccctcaactccctgtgtcccagatcctacaaagcaggcagaagaaatcttgaatgccatactacccccaagggagtgggtggaagacacgcagctatggatccagcaggtgtccagcacccctacgcaccaggatggacgtggtgcacctccaggagcagttagacttaaagctgcagcagcggcaggccagggaaacaggcatctgccctgtccgcaggaactctactcacagtgttttgatgagttgatccgggagtcaccatcaactgtgcggagagggggctgctgctgctgcagtcgggacgagatccgcatgaccatcgctgcctaccagaccctgtacgagagcagcgtggcgtttggcatgaggaaggcactgcaggctgagcaggggaagtcagacatggagaggaaaatcgcagaattggagacggaaaagagagacctggagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggcccaactggaaggcattattgcaccaaagaagtgataatttccacatgattaatttccaacaagacacttgggagttatttactgtgttcctctggcagccaataaaatcatcataagccctttgtaataaaaa

SEQ ID NO: 912 - DNA, 1679 bp, Homo sapiens
gtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttacttagtgttatg

SEQ ID NO: 913 - DNA, 2699 bp, Homo sapiens
  Modified_base 1740: n = a,c,g, or t
ggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttattttngtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 914 - DNA, 1526 bp, Homo sapiens
gtttttttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagat

SEQ ID NO: 915 - DNA, 7247 bp, Homo sapiens
gggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcagggatctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtccgtaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacacggaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaacccaacaaagggaagagtgaaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttgccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcgtcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaggtgtttatttttaactcttggaagaggttttgtggttcccaatgtgtctgtcccaccctgagccttttcaatatatatttctttaaaccttgtgctacttagtaaaaattgattacaattgagggaagtttgatagatcctttaaaaaaaaggcagatttccattttttgtattttaactactttactaaattaatactcctccttttacaaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttatatattaccgttatatctttggaaatccgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaaggacactaaactagattgactaataaaagtacaaggcacatatacgtgacagaattggtactcaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgttccaggttagcaaatgacctatcaaaaattattctataatcactactagttaggatattgatttaaaattgttctacttgaagtggtttctaagatttttatatttaaaaataggtgtgatttcctaatatgatctaaaaccctaaatggttatttttcctcagaatgatttgtaaatagctactggaaatattatacagtaataggagtgggtattatgcaacatcatggagagtgaaggcataggcttattctgacataaaattccactggccagttgaatatattctattccatgtccatactctgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagatgaaatttaggtcagggaaaagaccaagggccagcatgctacttttgtgtgtgtgtgtgtgggttttgttttgttttttttggttggctggttgttttcattattattaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtggcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcaaaaaaaaaaaaaaaaaaaaa

SEQ ID NO: 916 - DNA, 6911 bp, Homo sapiens
tcgaccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcaggcggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctctgtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacaaaaaaaaaaaaaaaaaaaaaaaaa

SEQ ID NO: 917 - DNA, 798 bp, Homo sapiens
gcggagccgggcccgcggggctgctgcggggcgatcgggccgggccgctgccgcgccatggactcccgtgtccagcctgagttccagcctcactgagtggccacccccaaagtgctgccagccgaggaagcccccagcactgaccatgtctattatggaccacagccccaccacgggcgtggtcacagtcatcgtcatcctcattgccatcgcggccctgggggccttgatcctgggctgctggtgctacctgcggctgcagcgcatcagccagtcagaggacgaggagagcatcgtgggggatggggagaccaaggaacccttcctgctggtgcagtattcggccaagggaccgtgcgtggagagaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaa

SEQ ID NO: 918 - DNA, 2225 bp, Homo sapiens
ggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcgctgagcacgggcatgaaggccatgatgtcagaattctgcacccagggagctgagatgtgccgcagggcctgtggcggacatggctactcaaagctgagtggcctgccatcactggtcaccaaattgtcggcctcctgcacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcccttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattag

SEQ ID NO: 919 - DNA, 1865 bp, Homo sapiens
gccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttagaaaaaaaaaaaaaaaaaaa

SEQ ID NO: 920 - DNA, 2184 bp, Homo sapiens
ccgccttcggcccgggcctcccgggatggccgtggcgcctctgcggggggcgctgctgctgtggcagctgctggcggcgggcggcgcggcactggagatcggccgcttcgacccggagcgcgggcgcggggctgcgccgtgccaggcggtggagatccccatgtgccgcggcatcggctacaacctgacccgcatgcccaacctgctgggccacacgtcgcagggcgaggcggctgccgagctagcggagttcgcgccgctggtgcagtacggctgccacagccacctgcgcttcttcctgtgctcgctctacgcgcccatgtgcaccgaccaggtctcgacgcccattcccgcctgccggcccatgtgcgagcaggcgcgcctgcgctgcgcgcccatcatggagcagttcaacttcggctggccggactcgctcgactgcgcccggctgcccacgcgcaacgacccgcacgcgctgtgcatggaggcgcccgagaacgccacggccggccccgcggagccccacaagggcctgggcatgctgcccgtggcgccgcggcccgcgcgccctcccggagacctgggcccgggcgcgggcggcagtggcacctgcgagaaccccgagaagttccagtacgtggagaagagccgctcgtgcgcaccgcgctgcgggcccggcgtcgaggtgttctggtcccggcgcgacaaggacttcgcgctggtctggatggccgtgtggtcggcgctgtgcttcttctccaccgccttcactgtgctcaccttcttgctggagccccaccgcttccagtaccccgagcgccccatcatcttcctctccatgtgctacaacgtctactcgctggccttcctgatccgtgcggtggccggagcgcagagcgtggcctgtgaccaggaggcgggcgcgctctacgtgatccaggagggcctggagaacacgggctgcacgctggtcttcctactgctctactacttcggcatggccagctcgctctggtgggtggtcctgacgctcacctggttcctggctgccgggaagaaatggggccacgaggccatcgaggcccacggcagctatttccacatggctgcctggggcctgcccgcgctcaagaccatcgtcatcctgaccctgcgcaaggtggcgggtgatgagctgactgggctttgctacgtggccagcacggatgcagcagcgctcacgggcttcgtgctggtgcccctctctggctacctggtgctgggcagtagtttcctcctgaccggcttcgtggccctcttccacatccgcaagatcatgaagacgggcggcaccaacacagagaagctggagaagctcatggtcaagatcggggtcttctccatcctctacacggtgcccgccacctgcgtcatcgtttgctatgtctacgaacgcctcaacatggacttctggcgccttcgggccacagagcagccatgcgcagcggccgcggggcccggaggccggagggactgctcgctgccagggggctcggtgcccaccgtggcggtcttcatgctcaaaattttcatgtcactggtggtggggatcaccagcggcgtctgggtgtggagctccaagactttccagacctggcagagcctgtgctaccgcaagatagcagctggccgggcccgggccaaggcctgccgcgcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgaggatcagggcgggaccccgtgaggctcattaggggagatgggggtctcccctaatgcgggggctggaccaggctgagtccccacagggtcctagtggaggatgtggaggggcggggcagaggggtccagccggagtttatttaatgatgtaatttattgttgcgttcctctggaagctgtgactggaataaacccccgcgtggcactgctgatcctctctggctgggaagggggaaggtaggaggtgaggc

SEQ ID NO: 921 - DNA, 393 bp, Homo sapiens
atgtcgggacgtggcaagcagggcggcaaagctcgcgccaaggctaagacccgttcttcaagggcgggtcttcagttcccagtgggccgagtgcaccgactgctccgcaagggcaactacgctgagcgggtcggtgccggagcgccggtgtacctggcggcggtgttggagtacctaaccgccgagatcctggaactggctggcaacgcggcccgcgacaacaagaagacccgcatcatcccgcgccacttgcagctggccatccgcaacgacgaggagctcaacaagctgcttggtaaagtgaccatcgcccagggtggtgtcctgcccaatatccaggccgtgctgctgcctaagaaaactgagagccaccacaaggccaagggcaagtag

SEQ ID NO: 922 - DNA, 1666 bp, Homo sapiens
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaagcactaaggttgcaaaagcttctcatttcagagagatgccaggatcctaagtgcctgccaaacttaccaattctaaggaataagtggatggatggcattactgattcctacattactgattgattctgcatccacaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaaaaa

SEQ ID NO: 923 - DNA, 2223 bp, Homo sapiens
acttcttttcttggctaagccgcgtttgtactgtgtcttaccatgcctgaaccggcaaaatccgctccggcgcctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggcactggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtttgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggcggcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttgctcagtttagcataacctcttatggattttcatcaaattcagcgtgttggtcactggaaagagccttttccttctccttttcttactctcccctcatggtgttcccctcttaaaggaggaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaa

SEQ ID NO: 924 - DNA, 312 bp, Homo sapiens
atgtctggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaa

SEQ ID NO: 925 - DNA, 1020 bp, Homo sapiens
ggccttccaaagtgctgggattacaggcgtgagtcaccgcgcccggccaaataaaataaaatgttaaagcaaattcaggactacccctcctccaagtcttctgttccctttgggcgcccaggtgagcgggggaggggctgggggagtaataacatcaaaagagcgccttttcctcccttattccgaggagacttccctgggcctgactcccggtcctgtccccagcgccccgcggcctctggagccccttcagtgaccaagatacagagatcaggacgcctttgcgccgccccaggtgcccgcccctagctggctctgcttgggccgcgagggaaggtgaggtcgggggcggagccggggcgtgacagccggggtgtgtgtccgccgggcttggtgcctccggtggccctgcagcaccgtcccacctctgccaccctccgatggggccgctacctgtgtgcctgccaatcatgctgctcctgctactgccgtcgctgctgctgctgctgcttctacctggccccgggtccggcgaggcctccaggatattacgtgtgcaccggcgtgggatcctggaactggcaggaactgtgggttgtgttggtccccgaacccccatcgcctatatgaaatatggttgcttttgtggcttgggaggccatggccagccccgcgatgccattgactggtgctgccatggccacgactgttgttacactcgagctgaggaggccggctgcagccccaagacagagcgctactcctggcagtgcgtcaatcagagcgtcctgtgcggaccggcagagaacaaatgccaagaactgttgtgcaagtgtgaccaggagattgctaactgcttagcccaaactgagtacaacttaaagtacctcttctacccccagttcctatgtgagccggactcgcccaagtgtgactgactaccttgacttgaaatgctcttttgcacaaggaaataaagcgtcctctcagtaatgaaaaaaaaaaaaaaaaaaaaaaaaa

SEQ ID NO: 926 - DNA, 1642 bp, Homo sapiens
gaatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctgtctgagtttgatactgtggggattcagtttaggcgctggcccgaggatatcccagcggtggtacttcggagacacctgtctgcatctgactgagcagaacaaatcgtcaggtgcctggagcaaaaagg

SEQ ID NO: 927 - DNA, 1772 bp, Homo sapiens
cgctgagaggctgagtggagttcactcacatggattgaggcccagttcctgggagaagagatgctgggcaggaaggtgtctgcatgtgggactctgtacagcccggtcctctcccacatctgggaggggccagagtcagacaactgctgggttcgtccctaagagaggtcatctgactggctgttcagcctaggctgcacacacccccactttcctctaccaggccacaccggagcagtgctcacacaggcaatctaccaggccacaacaacgacacccacctcacctctggcacctctgagcatccacgtacttgcaagaactcttgctcacatcagctaagagattgcacctgctgacctagagattccggcctgtgctcctgtgctgctgagcagggcaaccagtagcaccatgtctgtgactggcggggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagagagcaaaggcagctcatctcacgaaacttccaggagcgcacccaacaggacctgatgaagtctctacaggcagcactttccggcaacctggagaggattgtgatggctctgctgcagcccacagcccagtttgacgcccaggaattgaggacagctctgaaggcctcagattctgctgtggacgtggccattgaaattcttgccactcgaaccccaccccagctgcaggagtgcctggcagtctacaaacacaatttccaggtggaggctgtggatggcatcacatctgagaccagtggcatcttgcaggacctgctgttggccctggccaaggggggccgtgacagctactctggaatcattgactataatctggcagaacaagatgtccaggcactgcagcgggcagaaggacctagcagagaggaaacatgggtcccagtcttcacccagcgaaatcctgaacacctcatccgagtgtttgatcagtaccagcggagcactgggcaagagctggaggaggctgtccagaaccgtttccatggagatgctcaggtggctctgctcggcctagcttcggtgatcaagaacacaccgctgtactttgctgacaaacttcatcaagccctccaggaaactgagcccaattaccaagtcctgattcgcatccttatctctcgatgtgagactgaccttctgagtatcagagctgagttcaggaagaaatttgggaagtccctctactcttctctccaggatgcagtgaaaggggattgccagtcagccctcctggccttgtgcagggctgaagacatgtgagacttccctgccccaccccacatgacatccgaggatctgagatttccgtgtttggctgaacctgggagaccagctgggcctccaagtaggataacccctcactgagcaccacattctctagcttcttgttgaggctggaactgtttctttaaaatcccttaattttcccatctcaaaattatatctgtacctgggtcatccagctccttcttgggtgtggggaaatgagttttctttgatagtttctgcctcactcatccctcctgtaccctggccagaacatctcactgatactcgaattcttttggcaaaaaaaaaa

SEQ ID NO: 928 - DNA, 2607 bp, Homo sapiens
gaattcgggcagattagaccctggtcctacactcttagccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgctatcaccttcgtcttccaccagcattctcatgaggaacagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 929 - DNA, 2253 bp, Homo sapiens
ggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagaggcatcatggaccgatctaaagaaaactgcatttcaggacctgttaaggctacagctccagttggaggtccaaaacgtgttctcgtgactcagcaaattccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtctaaaaaaaaaaaaaaaa

SEQ ID NO: 930 - DNA, 2785 bp, Homo sapiens
tccgcaagcctccgcctctgtgcgcgggactggaggagcctcgctgagcccagggcgcgacggcgagaggagagggaaggcgggggagggctggaagggagaggaagggagtggttgggagccgggctgccgcagcctctagtctcctcagccgcggaagcacccctcctcctgcgccgcggccgcctccctcctcgctgtggaaagatgcccttagcccaggggtgtgaagaagggggagaagtagctgccagagccgcccgcgccgccgccgcagctgctgctcgttgtgtcctttgaattcagagaagcacccccccgcctggggcgtcgggagcctccgggcggcggccgcggtgcggtgtcggggagaccgggctctctgcccgcgcggcgcggcgcggctcggcccacgagcgaccaccgacatggagtgggctcgggcggccaagtagccgcttctccggagccggtgccagtgccgcccgcagcccgccttccacccccggccgcgccgccggtcaggccctagggtgaagccgggaggaaaatgaagagttttcacccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgccttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtacttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaatttgaaaaaaa

SEQ ID NO: 931 - DNA, 3238 bp, Homo sapiens
ccttggagactagaaagaaactgctagatggctgtaacacagttcatccatttccgtgaagagatcatggggaatatgttcttcatcatcatcttcagtaccaaggataaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtgggttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccggataaaattatttggaatgcctgctaagcatcagcctgatttgatatacctccggtatgtgccgctctggaaggtccatattttcacagtcattcagcttacttgcttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagacgatgatgatactgtgcaccttccatttgaagggggaagtctcttgcaaattccagtcaaggccctaaaatatagtggtgatccctcaattggtaacatatcagatgaaatggccaaaactgcacagtggaaggcactttccatgaatactgagaatgccaaagtaaccagatctaacatgagtcctgataaacctgtgagtgtgaaataagtttgagatgaaccaagaaagaaatacgtggagctgaaacttcatatagaatggaaccaagaggcatatacatatagatatatacatatgtaagggtgcgatcatggcactatatatagaatatggaggcaaggcgggtaaggggggactaacc

SEQ ID NO: 932 - DNA, 2326 bp, Homo sapiens
ccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacaacatgcaatgtgtctgtgtatgtgtgaatgtgagaaaaacacagccctcctttcagaaggaaaggggcctgaggtgccagctgtgtcctgggttaggggttgggggtcggccccttccagggccaggaaggcaggttccctctctggtgctgctgcttgcaagtcttagaggaaataaaaagggaagtgagaaaaaaaaa

SEQ ID NO: 933 - DNA, 4827 bp, Homo sapiens
gcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaagtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggctggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcatgtatcacagatgtaaattaactcaccagatttactgggcctgaactcattctcttcttgctatatgatttagcaagttctagaaggtctccaagacaataattacattggcacaatgtatacttcagtgctcacccgtagcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacatataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcaaaaaaaaaaaaaaaaaaaaaaaaaaaaaaaaaaaaaaaaaaa

SEQ ID NO: 934 - DNA, 647 bp, Homo sapiens
gctcactgagcaccgtcccagcatccggacaccacagcggcccttcgctccacgcagaaaaccacacttctcataccttcactcaacacttccttccccaaagccagaagatgcacaaggaggaacatgaggtggctgtgctgggggcaccccccagcaccatccttccaaggtccaccgtgattaacatccacagcgagacctccgtgcccgaccatgtcgtctggtccctgttcaacaccctcttcttgaactggtgctgtctgggcttcatagcattcgcctactccgtaaagtctagggacaggaagatggttggcgacgtgaccggggcccaggcctatgcctccaccgccaagtgcctgaacatctgggccctgattctgggcatcctcatgaccattggattcatcctgttactggtattcggctctgtaacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 935 - DNA, 2362 bp, Homo sapiens
ggaattccaaaaaaaaaaaatacgactacacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggcagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtcttccaaaagcagccatgatcactcatcagcgcatatggtatggaactggcctcacttttgtaagcggattgaaggcagatgatgtcatctatatcactctgcccttttaccacagtgctgcactactgattggcattcacggatgtattgtggctggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtggagaaagatgaacctgtccgagatgaaaatggatattgcgtcagagttcccaaaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggtggaaaggggaaaatgtggccaccactgaagttgctgatacagttggactggttgattttgtccaagaagtaaatgtttatggagtgcatgtgccagatcatgagggtcgcattggcatggcctccatcaaaatgaaagaaaaccatgaatttgatggaaagaaactctttcagcacattgctgattacctacctagttatgcaaggccccggtttctaagaatacaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaac

SEQ ID NO: 936 - DNA, 1392 bp, Homo sapiens
gaattccggcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccggaattc

SEQ ID NO: 937 - DNA, 2813 bp, Homo sapiens
ctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaacccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaggcagtggcaagtaagttatagaagagaaatgctgctagaaggaattaagcgttgtagtaaacgcgtgctcatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaactt

SEQ ID NO: 938 - DNA, 1318 bp, Homo sapiens
ctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcgtgagtacctggggctcctgcaggggtccactagccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaaaaaaaaaaaa

SEQ ID NO: 939 - DNA, 2922 bp, Homo sapiens
ggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaagatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataatttttttttctctagggagaggtacagtgtttatattttggagccttcctgaaggtgtaaaattgtaaatatttttatctatgagtaaatgttaagtagttgttttaaaatacttaataaaataattcttttcctgtggaag

SEQ ID NO: 940 - DNA, 1450 bp, Homo sapiens
cggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaagacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaaaaaaa

SEQ ID NO: 941 - DNA, 1375 bp, Homo sapiens
  Modified_base 1246, 1256: n = a,c,g, or t
gccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatcntcgagagatnagatgagatatatataaaaaataaaaagctatttctagtttatttcactataaagttttgctttattaaaaagctaataaacagctattaatcacaaaaaaaaaaaaaaaaaaaaaaaa

SEQ ID NO: 942 - DNA, 960 bp, Homo sapiens
cccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttg

SEQ ID NO: 943 - DNA, 1771 bp, Homo sapiens
ggcgactccgggaacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggacctcgcttgcaccgcgggacgaggctgaccgggctgttctgtagactcaggaccgtggctccagaactctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcaggccttgcaagggaaaaaaaaaaaaaaaaaaa

SEQ ID NO: 944 - DNA, 2921 bp, Homo sapiens
gcacgaggtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttaaaaaaaaaaaaaaaaaaa

SEQ ID NO: 945 - DNA, 1331 bp, Homo sapiens
ccgcgtctcgcgtagtctcccgcgccgccgtccactgcgcgcttcgctctccgccgcccgaggcccgcgcgctcgccatgtcccggccaccgccaccgcgggtcgcctcggtgctgggcaccatggagatggggcgccgcatggacgcgcccgccagcgccgcggccgtgcgcgcctttctggagcgcggccacaccgaactggacacggccttcatgtacagcgacggccagtccgagaccatcctgggcggcctggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacacacctgaccacggcaccccggtggaagagacgctgcatgcctgccagcggctgcaccaggagggcaagttcgtggagcttggcctctccaactatgctagctgggaagtggccgagatctgtaccctctgcaagagcaatggctggatcctgcccactgtgtaccagggcatgtacaacgccaccacccggcaggtggaaacggagctcttcccctgcctcaggcactttggactgaggttctatgcctacaaccctctggctgggggcctgctgactggcaagtacaagtatgaggacaaggacgggaaacagcctgtgggccgcttctttgggaatagctgggctgagacctacaggaatcgcttctggaaggagcaccacttcgaggccattgcgttggtggagaaggccctgcaggccgcatatggcgccagcgcccccagtgtgacctcggctgccctccggtggatgtaccaccactcacagctgcagggtgcccacggggacgcggtcatcctgggcatgtccagcctggagcagctggagcagaacttggcagcaacagaggaagggcccctggagccggctgtcgtggatgcctttaatcaagcctggcatttggttgctcacgaatgtcccaactacttccgctaggcccatcatggctcaggctgcccaaggcttttctgtcacctcttttgttctctcacactgaccagtcttggccttaagctgacttagaagggtttttctgaattgtctagatccatgcattatttttctagcttcctgccttgctccctattcactttacactgtgaaaggtggggggtgagtcccacttgagcgcttcctgttgaataaagcaggcacttgacctggctgtagcctaggtcttgagtgaaccccaaaaaa

SEQ ID NO: 946 - DNA, 2380 bp, Homo sapiens
gaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagagagagagagagagggagaggaagaaaagagagagagaaaagagcctcgtgcc

SEQ ID NO: 947 - DNA, 1080 bp, Homo sapiens
ctcgcgcaagcggcgtgcggtcccgcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgccaaactctggaatgaatggtgtagaacaacagacactacacatctgtcctccacagaggctttttgtgtgttttatcatctaaaatccaatccctcggtttttctctgtcagtgcagttgctatgttgcagaagatcaacagtatcagtggctggaaaaggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatgatcttaaacattgttttgtagtgtatattacttgtccattcctttaaggggagcagcctgcactcttttgtagattacttttgggggatatattttgagaatgatgaaacggaataaaattgtaaaaaactaaaaaaaaaaaaaaaaaaaa

SEQ ID NO: 948 - DNA, 1524 bp, Homo sapiens
gtcgccttccagcccgtccgcctcccgaccagggcccgcgccccgtcccgcctctctcccgcccagccaaatgcaggccgccgccctccctgaggagatccgttggctcctggaagatgctgaagagtttctggcagaaggtttgcggaatgagaacctcagcgctgttgcaagggatcacagagaccatattctacggggctttcagcaaatcaaagccaggtactattgggattttcagccccaagggggagacattggacaggacagctctgatgataatcacagcgggactcttggcctgtccctcacatccgatgcaccctttttgtcagattatcaggatgagggaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagagcaagcagcccaaagggaccttcctcattaagggctacagtgtacggatggccccccacctgcgaagagattccaagaaagaatcctgctttgaactgacctcccaggataggcgcacgtatgagtttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacagaggagaaagaagaagaagatatttatgaagtcttgccagatgaagagcatgatctagaagaggatgagagtggcactcgacgaaaaggagtagactatgccagttactaccagggcctatgggattgccatggtgaccagccagatgaactgtccttccaacggggtgacctcatccgtattctgagcaaggagtataacatgtatggctggtgggtgggagaactgaacagcctcgttgggattgttccaaaggagtatctcaccactgcctttgaagtggaagaaagatgaaacccaggaaatatattcttccctctctcctcctttatgaggaaactgatcatcaaaagttcccactccctacttctgcacccaccaacgcctgactcctctctttgctgaagagacccaagtctcttgacacctcagagtgactgtaagctaccagtaagacaagtgggaagaggcacgttcatcaaacctgttactaaaccagcctagtcatagctcatccccatgtgtaaatgtgtccacacaaccacatctgccttttccacaagcttttcacaaagaaggtgagagagaaggaaaccttgggaggaggacattactggttgttctggctggtttgaaaagcacaaataaacttgggatgtggttccttg

SEQ ID NO: 949 - DNA, 1539 bp, Homo sapiens
gctgactccagtgtcccgagaggcgccgcttcttccgctttctcgtcaggctcctgcaaccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgag

SEQ ID NO: 950 - DNA, 3514 bp, Homo sapiens
agcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgagagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtggtatctgatgctgcaggacagggtgtggccatcacagggaaccagaccttcaacaactggaactggcccaatgcaatgatttttgcagcgaccgtcattaccaccattggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctgcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtggggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagccccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcacgggcctgaaaaggagcagcctcgtatttttctgtgaaatgttttaatgaaccatgttgttgctggttgtcctggcatcccgcacactgtatgtacatactggcaacgatgtcaaatgtaatttattttaacatttttacaataaaacatgaggtggacaggcaaaaaaaaaaaaaaaaaaaaaaaaaaaaaaaaaaaaa

SEQ ID NO: 951 - DNA, 3134 bp, Homo sapiens
tccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtgatgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggctgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgtaaagtgttgggtcttcctccaggatgcctgcatgggaccccacccggagctggtgtggccattccccgaagtgccactggcccatggatgggggtgggtgctggtgcacctgggctgggtgtgggttctgtgtccttccaggatctgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 952 - DNA, 2889 bp, Homo sapiens
ccacgcgtccgataataaagaaacttgaagacggaggttcttccaaacaactggcagtgatttatggaattggtgaaacaacagttcgggatataagaaaaaataaggaaaagattataacttatgcaagcagttctgattccacaagtcttttggccaagaggaaatctatgaagccatccatgtatgaggaattggacagggcaatgctggaatggttcaaccagcaaagagcaaaagggaatcccatatctggaccaatttgtgcaaaaagggcagagttcttcttttatgctttgggaatggatggtgattttaacccctctgccggttggctaactcgttttaagcagcggcacagcattagagagattaacattagaaatgaaagattaaatggagatgagactgcggtggaagatttttgtaataactttcgagattttattgaacgagagaatttacagcctgaacaaatctacaatgcagatgaaactggactcttttggaagtgcttgccttctaggatttcagtaatcaaaggtaaatgcactgtccctgggcacaaatcaattgaagaaagagtcacaatcatgtgttgtgccaatgcaacaggtttacacaaacttaaactttgtgttgtggggaaagcaaagaaacctcgctcctttaaatcaactgacaccttaaacctgccagtctcttatttcagccaaaaaggtgcatggatggatctttccattttccgacaatggtttgataaaatttttgtgccgcaagttcgagagtatttaagatctaaaggcttgcaggaaaaggctgtgctcttgttggataattcaccaacacatccaaatgaaaatgtcctaaggtcagatgatggccaaatatttgctaaatatttaccacctaatgtggcctcattgattcagccttcagatcagggagtcatagcaacgatgaagagaaattatcgtgcaggtcttctccagaacaacttggaagaaggtaatgacctgaaatcattctggaagaagctaactctgttggatgcactttatgaaatagcaatggcatggaacttagtaaaaccagttaccattagcagagcatggaagaagattctccctatggtagaggagaaagagagcctggactttgatgttgaagatatttctgtggctactgtggctgccattttacaacacaccaaaggattggaaaatgtgactactgagaaccttgaaaaatggcttgaagtagacagtactgaaccaggctatgaagtgttaactgatagcgaaatcatcagaagagcacaaggccaggcagatgaatccagtgaaaatgaggaggaggaaatagaactaattccagagaaacatattaatcatgcagctgccctccagtggactgaaaatttattggattatctagaacaacaaggtgatatgattctacctgatagactggtaatacgtaaacttcgagccaccatcagaaataaacagaagatgacaaagtcaagtcaataatgtcatttcaattttattgttctgctcattgtgtttgtgacaaactctttgcaatatggcttaattttctttgtgttctgaattctcagacttggtcctgtgaaatacaggcacaaaatgtatctgaagtggtttgaggattatgtgttttcatcatctgtgtcttttgtccttttatttgtacagataatcagaagatgatactgaatagatataaattacatgtacacatgtattcactttttagaatctgcaattataccttctgtaacagtggcattcccttaattttctagtgaaagttagagataactgaacagactgaagcacttttctgaaatcttttgcttgatttatgaaggctgccatagttatcttttcttgtgttaaccatcttaaatgatgttttgtatattttatagactgataggatgagaaagatttatattattagatttcaggatgatttataataattcaaaaatgaaattcaataatggggaaataattatgaattatagaaattatgccttcattctcttacatttgtgtgggttgcaagagggggagattattctggaaatgaagtaaatatgggaagttattgccaaatgagagagaaactatgggaaagctgatctataaagaggcattctgatcaattcatttgtaggaaactgggaaataaaaacctggggaactttaggttatttatacaaagggaataaataggctgattttaatttggtaagttgatctttttattatgaatttggtaatagtataggtttattatttattcatctaattttatagtacaggttttgtaatgttacatgtgatgatatgagctcccaccttatatgggggaacatcttgggaatttgagatttaataagttttttttttttttttttagtgtttttactgcatactcacaaatgttgtctataatttgaaaaatattgtcatatctggccctttgatgagaaaaggaaattacaataataaagttttatgattttaaataagtcatatgtttgtatcctgttttatgaagaaagcagaaataattactgaaagtgccagacactaaggaatattattgtttattattttaatacatataaaaagggattaatctgctaaaatgtaatctaaatcagaattttgataaattttttttgtaaactaagtatgtttattcaagacattgaaactactttgcacatatgaatattaatgtaacttgtaatttaaaagtaaagtgtttccatgctatttcatgttttggccaaaaatttttaaaaaataaattacaattgttctctattagtaaaaaaaaaaaaaaaaa

SEQ ID NO: 953 - DNA, 4338 bp, Homo sapiens
cagggcacgctgggtcggcggagctgaggctcccagctgtgggcctcgctggcccggtcgcccagtctcgcgagagttgggagtaaacagccccgaatggagtgcccaggcgtgttcgccgcggaggcgccgttatcccgggcccgccggccctgagctcccggcggcgcagattggctcacagtggttgattgatcaaccccattggacgttggttctgtggtacaaatggagtacaggactcagtcgtcacggcctgagtgagagaagccttatttccaagatggagaagaagcggagaaagaaatgaaagcctctcttcaggctgaaccacaaaaggccatgggatttaacttttatttatgttgggcaagactgtaagatggctgatcagtaatgttgcagcttttagctgaaacaaaaattcacttttaatcaagaagaaaaaagtgtgatttgaatatatgcaattttatgatcatattcgcttgtgaccatgaagcttgtcaacatctggctgcttctgctcgtggttttgctctgtgggaagaaacatctgggcgacagactggaaaagaaatcttttgaaaaggccccatgccctggctgttcccacctgactttgaaggtggaattctcatcaacagttgtggaatatgaatatattgtggctttcaatggatactttacagccaaagctagaaattcatttatttcaagtgccctgaagagcagtgaagtagacaattggagaattatacctcgaaacaatccatccagtgactaccctagtgattttgaggtgattcagataaaagaaaaacagaaagcggggctgctaacacttgaagatcatccaaacatcaaacgggtcacgccccaacgaaaagtctttcgttccctcaagtatgctgaatctgaccccacagtaccctgcaatgaaacccggtggagccagaagtggcaatcatcacgtcccctgcgaagagccagcctctccctgggctctggcttctggcatgctacgggaaggcattcgagcagacggctgctgagagccatcccgcgccaggttgcccagacactgcaggcagatgtgctctggcagatgggatatacaggtgctaatgtaagagttgctgtttttgacactgggctgagcgagaagcatccccacttcaaaaatgtgaaggagagaaccaactggaccaacgagcgaacgctggacgatgggttgggccatggcacattcgtggcaggtgtgatagccagcatgagggagtgccaaggatttgctccagatgcagaacttcacattttcagggtctttaccaataatcaggtatcttacacatcttggtttttggacgccttcaactatgccattttaaagaagatcgacgtgttaaacctcagcatcggcggcccggacttcatggatcatccgtttgttgacaaggtgtgggaattaacagctaacaatgtaatcatggtttctgctattggcaatgacggacctctttatggcactctgaataaccctgctgatcaaatggatgtgattggagtaggcggcattgactttgaagataacatcgcccgcttttcttcaaggggaatgactacctgggagctaccaggaggctacggtcgcatgaaacctgacattgtcacctatggtgctggcgtgcggggttctggcgtgaaaggggggtgccgggccctctcagggaccagtgttgcttctccagtggttgcaggtgctgtcaccttgttagtgagcacagtccagaagcgtgagctggtgaatcccgccagtatgaagcaggccctgatcgcgtcagcccggaggctccccggggtcaacatgtttgagcaaggccacggcaagctcgatctgctcagagcctatcagatcctcaacagctacaagccacaggcaagtttgagccccagctacatagatctgactgagtgtccctacatgtggccctactgctcccagcccatctactatggaggaatgccgacagttgttaatgtcaccatcctcaacggcatgggagtcacaggaagaattgtagataagcctgactggcagccctatttgccacagaacggagacaacattgaagttgccttctcctactcctcggtcttatggccttggtcgggctacctggccatctccatttctgtgaccaagaaagcggcttcctgggaaggcattgctcagggccatgtcatgatcactgtggcttccccagcagagacagagtcaaaaaatggtgcagaacagacttcaacagtaaagctccccattaaggtgaagataattcctactcccccgcgaagcaagagagttctctgggatcagtaccacaacctccgctatccacctggctatttccccagggataatttaaggatgaagaatgaccctttagactggaatggtgatcacatccacaccaatttcagggatatgtaccagcatctgagaagcatgggctactttgtagaggtcctcggggcccccttcacgtgttttgatgccagtcagtatggcactttgctgatggtggacagtgaggaggagtacttccctgaagagatcgccaagctccggagggacgtggacaacggcctctcgctcgtcatcttcagtgactggtacaacacttctgttatgagaaaagtgaagttttatgatgaaaacacaaggcagtggtggatgccggataccggaggagctaacatcccagctctgaatgagctgctgtctgtgtggaacatggggttcagcgatggcctgtatgaaggggagttcaccctggccaaccatgacatgtattatgcgtcagggtgcagcatcgcgaagtttccagaagatggcgtcgtgataacacagactttcaaggaccaaggattggaggttttaaagcaggaaacagcagttgttgaaaacgtccccattttgggactttatcagattccagctgagggtggaggccggattgtactgtatggggactccaattgcttggatgacagtcaccgacagaaggactgcttttggcttctggatgccctcctccagtacacatcgtatggggtgacaccgcctagcctcagtcactctgggaaccgccagcgccctcccagtggagcaggctcagtcactccagagaggatggaaggaaaccatcttcatcggtactccaaggttctggaggcccatttgggagacccaaaacctcggcctctaccagcctgtccacgcttgtcttgggccaagccacagcctttaaacgagacggcgcccagtaacctttggaaacatcagaagctactctccattgacctggacaaggtggtgttacccaactttcgatcgaatcgccctcaagtgaggcccttgtcccctggagagagcggcgcctgggacattcctggagggatcatgcctggccgctacaaccaggaggtgggccagaccattcctgtctttgccttcctgggagccatggtggtcctggccttctttgtggtacaaatcaacaaggccaagagcaggccgaagcggaggaagcccagggtgaagcgcccgcagctcatgcagcaggttcacccgccaaagaccccttcggtgtgaccggcagcctggctgaccgtgagggccagagagagccttcacggacggcgctggtgggtgagccgagctgtggtggcggctggtttaaaagggatccagtttccagctgcaggtttgttagagtctgttctacatgggcctgccctcctgtgatgggcagaggctcctggtacatcgagaagattcctgtggatcccgtcaggagggacttagtggctctgccgccagtgagacttcccgccggcagctgtgcgcaccaaagactcgggagaactggaaaggctgtctggggtcttctgactgcaggggaaggatgtactttccaaacaaatgatacaaccctgaccaagctaaaagacgcttgttaaaggctattttctatatttattgttgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaatctgtaaaacatagaccttcgctttatttttgtaagtatcacctgccaccatgttttgtaatttgaggtcttgatttcaccattgtcggtgaagaaaattttcaataaatatgtattacccgtctgaagctt

SEQ ID NO: 954 - DNA, 2039 bp, Homo sapiens
ggaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcctacccgcttcgcgctggagatgttcaaccgcggccgggctgcggggacgcgggccgtgctgggccttgtgcgcggccgcgtccgccgggcgggccaagggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtaaaaaaaaaaaaaaaaaaaaaaaaaaaaaa

SEQ ID NO: 955 - DNA, 1201 bp, Homo sapiens
gggcgaggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcaaaaaaaaaaaaaaaaaaaaaaaaaaaaaaaaaa

SEQ ID NO: 956 - DNA, 716 bp, Homo sapiens
gaaacttggtgtccaggggaggcccccggcggctggagcgcggcggcagcgggcgcagaggccggagggagaggaggcgaggggcggcccgagcgcggggcgggagcgaggccagcggtcatgtgcccgtgccccctgcaccgcggccgcggccccccggccgtgtgcgcctgcagcgcgggtcgcctggggctgcgctcgtccgccgcgcagctcaccgccgcccggctcaaggcgctaggcgacgagctgcaccagcgcaccatgtggcggcgccgcgcgcggagccggagggcgccggcgcccggcgcgctccccacctactggccttggctgtgcgcggccgcgcaggtggcggcgctggcggcctggctgctcggcaggcggaacttgtaggaacgcggggcttcttggtggggccggagccgagacccagccggagcgagcaacaggttggtgaaaaccctgtgtccttggagaaagctggttcccgttttccagagggggagcccagagcttgaaaggccgcggttggcacttcgagaaggaagtggagagtaaagacagcgcctggagcgatcgtagaaacacagaatgggactggggaagccctttggaaatccagctgcagaaacagacaccccaatgctatttacatacagctctatatatataaaaaaagaaaatatgaatattaaaaaaaaaaaaaaaaaaaa

SEQ ID NO: 957 - DNA, 1623 bp, Homo sapiens
atgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagtgaaagaaaggatgtcttaagagaagctgaaattttacacaaagctagatttagttacattcttccaattttgggaatttgcaatgagcctgaatttttgggaatagttactgaatacatgccaaatggatcattaaatgaactcctacataggaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggacagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaa

SEQ ID NO: 958 - DNA, 6582 bp, Homo sapiens
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaagttaggatgaaaaatgaaaatataaaaaaaaaaaaaaaaaaa

SEQ ID NO: 959 - DNA, 2856 bp, Homo sapiens
gaattcgcggccgccccgcctgtgtcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatccaccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacatattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgcgcggccgcgaattc

SEQ ID NO: 960 - DNA, 1546 bp, Homo sapiens
cacggccggagagacgcggaggaggagacatgagccggcgggcgcccagacggagcggccgtgacgctttcgcgctgcagccgcgcgccccgaccccggagcgctgacccctggccccacgcagctccgcgcccgggccggagagcgcaactcggcttccagacccgccgcgcatgctgtccccggactgagccgggcagccagcctcccacggacgcccggacggccggccggccagcagtgagcgagcttccccgcaccggccaggcgcctcctgcacagcggctgccgccccgcagcccctgcgccagcccggagggcgcagcgctcgggaggagccgcgcggggcgctgatgccgcagggcgcgccgcggagcgccccggagcagcagagtctgcagcagcagcagccggcgaggagggagcagcagcagcggcggcggcggcggcggcggcggcggaggcgcccggtcccggccgcgcggagcggacatgtgcaggctgggctaggagccgccgcctccctcccgcccagcgatgtattcagcgccctccgcctgcacttgcctgtgtttacacttcctgctgctgtgcttccaggtacaggtgctggttgccgaggagaacgtggacttccgcatccacgtggagaaccagacgcgggctcgggacgatgtgagccgtaagcagctgcggctgtaccagctctacagccggaccagtgggaaacacatccaggtcctgggccgcaggatcagtgcccgcggcgaggatggggacaagtatgcccagctcctagtggagacagacaccttcggtagtcaagtccggatcaagggcaaggagacggaattctacctgtgcatgaaccgcaaaggcaagctcgtggggaagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggcccctcaggtcgccctggccacactcacactcccagaaaactgcatcagaggaatatttttacatgaaaaataaggaagaagctctatttttgtacattgtgtttaaaagaagacaaaaactgaaccaaaactcttggggggaggggtgataaggattttattgttgacttgaaacccccgatgacaaaagactcacgcaaagggactgtagtcaacccacaggtgcttgtctctctctaggaacagacaactctaaactcgtccccagaggaggacttgaatgaggaaaccaacactttgagaaaccaaagtcctttttcccaaaggttctgaaaggaaaaaaaaaaaaaaacaaaaaaaaaaaaaaaa

SEQ ID NO: 961 - DNA, 2937 bp, Homo sapiens
caatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttacgcactgtgatcaaatggtgaatatgttccaagacattctgacagaacttgccaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggtggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggattgttaagtacatacagcgatgaaattggaatgttagaggacatgcccgttggcatttccgatttaaagaaagttgcatttaaaataattgaagccaaatccaatgatgtattgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttc

SEQ ID NO: 962 - DNA, 2212 bp, Homo sapiens
tgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttc

SEQ ID NO: 963 - DNA, 1280 bp, Homo sapiens
tgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattatgtatgtgactatttatataacattagataattaaatagtgagacataaatagagtgctttttcatggaaaagccttcttatatctgaagattgaaaaataaatttactgaaatacaaaaaaaaaaaaaaa

SEQ ID NO: 964 - DNA, 2830 bp, Homo sapiens
cccacgcgtccgctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggccctctctccagcccctacgaccatggactttactccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacaggtggtcggtgtgggctgcgtcctggatggggtgcgctacaacaacggccagtccttccagcctaactgcaagtacaactgcacgtgcatcgacggcgcggtgggctgcacaccactgtgcctccgagtgcgccccccgcgtctctggtgcccccacccgcggcgcgtgagcatacctggccactgctgtgagcagtgggtatgtgaggacgacgccaagaggccacgcaagaccgcaccccgtgacacaggagccttcgatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttctttagatgccaaaccacaagactctttgggtccattcagatgaatagatggaatttggaacaatagaataatctattatttggagcctgccaagaggtactgtaatgggtaattctgacgtcagcgcaccaaaactatcctgattccaaatatgtatgcacctcaaggtcatcaaacatttgccaagtgagttgaatagttgcttaattttgatttttaatggaaagttgtatccattaacctgggcattgttgaggttaagtttctcttcacccctacactgtgaagggtacagattaggtttgtcccagtcagaaataaaatttgataaacattcctgttgatgggaaaagcccccagttaatactccagagacagggaaaggtcagcccatttcagaaggaccaattgactctcacactgaatcagctgctgactggcagggctttgggcagttggccaggctcttccttgaatcttctcccttgtcctgcttgggttcataggaattggtaaggcctctggactggcctgtctggcccctgagagtggtgccctggaacactcctctactcttacagagccttgagagacccagctgcagaccatgccagacccactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccagttgtttagaaacagaaatagacttaataaaggtttaaagctgaagaggttgaagctaaaaggaaaaggttgttgttaatgaatatcaggctattatttattgtattaggaaaatataatatttactgttagaattcttttatttagggccttttctgtgccagacattgctctcagtgctttgcatgtattagctcactgaatcttcacgacaatgttgagaagttcccattattatttctgttcttacaaatgtgaaacggaagctcatagaggtgagaaaactcaaccagagtcacccagttggtgactgggaaagttaggattcagatcgaaattggactgtctttataacccatattttccccctgtttttagagcttccaaatgtgtcagaataggaaaacattgcaataaatggcttgattttttaaaaaaaaaaaaaaaaaaaaaaa

SEQ ID NO: 965 - DNA, 1337 bp, Homo sapiens
gtggtcgagccgcgcgcagggtgcgctcgtttgaactgcggtgacaccgagggttggggactcgaacccccgcttcgcagctcaggagcctgaggtccgaaagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagtcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatga

SEQ ID NO: 966 - DNA, 1230 bp, Homo sapiens
ctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctacgaggtagaggggtgggggttggtgggctgtcacggagcgactgtcgagatcgcctagtatgttctgtgaacacaaataaaattgatttactgtctgctaaaaaaaaaaa

SEQ ID NO: 967 - DNA, 1817 bp, Homo sapiens
ggcacgagctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtttgagtcagagatctgtgcacactttttaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctttatcctttaaggttggaactttgaagttggagaaggtggaataaagttacacctggaaaaaaaaaaaaaaaaaaaaaaaaaaaaaaaaaaaaaaaaaaaaa

SEQ ID NO: 968 - DNA, 2443 bp, Homo sapiens
ccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacatgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctcc

SEQ ID NO: 969 - DNA, 4668 bp, Homo sapiens
gccaccggcagcgcttgttagaatgcagattcccggggttcgactggaatgagaccccggggagcagcgtttgcagcgggcccgccaggtgacctgcacctgggcaccgccatcggcttcgcaggggccatctggaggagtcggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgccaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggatgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgcgcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtcgctccaggtagcggacaaaattttccttcccctcacaggcgtcggttgtgagtgtcagcaccaacttgccagtggatggtattttctcagggtcctgcacggagcctccc

SEQ ID NO: 970 - DNA, 1637 bp, Homo sapiens
aagaactggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttac

SEQ ID NO: 971 - DNA, 2738 bp, Homo sapiens
cgcggaattccgcggaattccgcgccgccgccgccggcagaccccgcgctccggctccggctcggctcgctcggctccggtgcgcgccgaggccatgcagcgccggggcgccctgttcggcatgccgggcggcagcggaggcaggaagatggctgcaggagacatcggcgagctgctagtgccccacatgcccacgatccgcgtgcccaggtccggcgacagggtctacaagaacgagtgcgccttctcctacgactctcccaattctgaaggtggactctatgtatgcatgaatacatttttggcctttggaagggaacatgttgaaagacattttcgaaaaactggacagagtgtatacatgcacctgaaaagacatgcgcgagagaaggtaagaggggcgtctggtggagcgttaccaaaaaggaggaattccaagatttttttagatctagatactgatgacgatttaaatagcgacgattatgaatatgaagatgaagccaaacttgttatattcccagatcactatgaaatagcactaccaaatattgaggagttaccagccctggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaagtggttggaagtgtgccagatgcgacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcagatgtttattcttttcaagaagaagaacctgttttggatcctcatttggccaagcacttagcgcattttggaattgatatgcttcatatgcatgggacagagaatgggctccaggacaatgacatcaagctgagggtcagtgagtgggaagtgatccaggagtcgggcacgaaactgaagccaatgtatggtcctggctacacgggtctgaagaacctgggcaacagctgctatctcagctctgtcatgcaggccatcttcagcatcccagaattccagagagcgtatgtaggaaaccttcccagaatatttgactactcgcctttagatccaacacaagatttcaacacacagatgactaagttaggacatggccttctctcaggccagtattcaaagcctccggtgaaatctgaactcattgaacaggtgatgaaggaggagcacaagccacagcagaacgggatctctccgcgcatgtttaaggcctttgtaagcaagagccacccggaattctcctctaacaggcagcaagatgcccaggaattcttcttgcacctggtgaatctagtagagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaaggatgaactgatcgcttatgaactaacgagaagggaagcagaagcaaacagaagaccccttcctgagttggtacgtgccaagataccatttagtgcctgccttcaggccttctctgaaccagaaaatgttgatgatttctggagcagtgccctacaagcaaagtctgcgggtgtgaaaacatctcgctttgcttcattccctgaatacttggtagtgcagataaagaagttcacttttggtcttgactgggttcccaaaaaatttgatgtttctattgatatgccagacctacttgatatcaaccatctccgagccagggggttacagccaggagaggaagaacttccagacatcagcccccccatagtcattcctgatgactcaaaagatcgcctgatgaaccaattgatagacccatcagacatcgatgagtcatcagtgatgcagctggccgagatgggtttcccgctggaagcatgtcgcaaggctgtgtacttcactggaaatatgggcgccgaggtggccttcaactggatcattgttcacatggaagagccagattttgctgagccgctgaccatgcctggttatggaggggcagcttctgctggagcctctgtttttggtgcttctggactggataaccaacctccagaggaaatcgtagctatcatcacctccatgggatttcagcgaaatcaggctattcaggcactacgagcaacgaataataacctggaaagagcactggattggatctttagccaccctgagtttgaagaagacagtgattttgtgattgagatggagaataatgccaatgcaaacattatttctgaggccaagcccgaaggacctagagtcaaggatggatctggaacatatgagctatttgcattcatcagtcacatgggaacatccacaatgagtggtcattacatttgccatatcaaaaaggaaggaagatgggtgatttacaatgaccacaaagtttgtgcctcagaaaggccccctaaagacctgggctacatgtacttttaccgcaggataccaagctaaacctcaaatataaaaattggcgaaaagaagccatacgcctttttaatttgcc

SEQ ID NO: 972 - DNA, 3131 bp, Homo sapiens
ggagccgccatgtaaccggcgccgcccggagcccgagccgcgcgggccccagcgacccgcccgccatgggggacgaggacgacgatgagagctgcgccgtggagctgcggatcacagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaggagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcaggactcgcccttcttccagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggcaaaaaaaaaaaaa

SEQ ID NO: 973 - DNA, 1429 bp, Homo sapiens
cagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctacagcagctgcttcggtgatagcaccaagtcgcgcaacaagctggtcttgcccagtctcatctcctctcgcatctatgtggtggacgtgggctctgagcccgggccccaaaagctgcacaaggtcattgagcccaaggacatccatgccaagtgcgaactggcctgtctccacaccagccactgcctggccagcggggaagtgatgatcagctccctgggggacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggctttaaccccgctgatgtggaggctggactgtacgggagccacttatatgtatgggactggcagcgccatgagattgtgcagaccctgtctctaaaagatgggctgatacccttggagatccgcttcctgcacaacccaagtgccacccagggttttgtaggctgtgcctcagctccaaacatccagcgcttctacaaaacgagggaaggtacatggtcagtggagaaggtgatccaggtgccccccaagaaagtgaagggctggctgctgccaggggtgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatggcaagcgcctctacatcaccacgtcgctgtacagtgcctgggaaaagcagttttaccctgatctcatcagggaaggctctgtaatgctgcaggttgatgtagacacagtaaaaggagggctgaagttgaaccccaactgcctggtggacttcgggaaggagccccttggcccagccctggctcacgagcttcgctaccctgggggcgattgtagctctgacatctggatttgaaggctc

SEQ ID NO: 974 - DNA, 1151 bp, Homo sapiens
gcgcgggttggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatccttaaaaaaaaaaaaaaaaaaaaaaaaaaa

SEQ ID NO: 975 - DNA, 4596 bp, Homo sapiens
aagcgggggactgtgccgtgtggaacgtgtagctgttgagaggtggactctgttaccattgaggatgtttggaggatgagtatgtgtggcagaggcacacataaacaggcagagaccctttgcccctgcctttctcccccaacccaaggctgacctgtgttctcccaggtctgggattctaagtgacctgctctgtgtttggtctctctcaggatgagcacaagcctgggagatggcagtgatggaaatggcctgcccaggtgcccctggctcagcagtggggcagcagaaggaactccccaagccaaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtcaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaaagcagccttcctgctcggtgcacgatgctgccctgaaaacacaggctcagccgttcccaggggattgccagccccccggctcacagtgggaaccagggcctcgcagcagcaaggtgggggcaagcagaatgcctcccaggatttcacacctgagccctgccccaccctgctgaaaaaacatccgccacgtgaagagacagaaggaggatggcaggagttacctggggaaacaaaacagggatctttttctgcccctgctccagtcgagttggcctgacccgcttggatcagtgaccatttgttggcagacaggggagagcagcttccagcctgggtcagaaggggtgggcgagcccttcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgtccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgttaaaaaa

SEQ ID NO: 976 - DNA, 1592 bp, Homo sapiens
ggagagatgatgagttgctgagtgtgcacacctttccggaacacatacacacaccctgctctgggatcccttgtgaggctgccctcatggagttccccctggcccagatatgtccccaagggagtcacgaagcccccatcccaaccttcagcaccttccagatcacagacatgacccgcaggagctgccagaacctgggctacactgcggcatctccccaggccccggaggctgcctccagcacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacagggaaa

SEQ ID NO: 977 - DNA, 3044 bp, Homo sapiens
gtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggagtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactggcaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccagattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttacctcatacagtacgtgtcctgtttttaaaatatacaattattcttaaaaataaattaaaatcgtatacttacatttcaaaaaaaaaaaaaaaaa

SEQ ID NO: 978 - DNA, 2245 bp, Homo sapiens
agctgttgcagcatgagcgatacgcttggttctcctaactagcaccttcccctctcccctgactcagctggtagcccctcctccccgcacctgcccaaaggtcactggacaggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttcaaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaaaaaaaaaaaaaaaaaaaaaaaaaaaaa

SEQ ID NO: 979 - DNA, 1599 bp, Homo sapiens
ggaccaaagctgacagtttctttacttgcaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacatgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtacctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgttgcatgcctgctctaatttcttttgcccatatatgagtatctccagaatgtctacaaatagtttttgtagcaaatgaaaatttcttcaaataagccttttgtttcaaataaaacttgtctcaaaacatgcttcaaaaaaaaaaaaaaa

SEQ ID NO: 980 - DNA, 2699 bp, Homo sapiens
  Modified_base 724, 1270, 1334, 1448, 1449, 1596, 1598, 2230, 2231, 2552: n = a,c,g, or t
tggaagagatcacagggagtccagaaacgcctgtcatcccaagcttatgctgtttttctaaaagctctttatgggggcttgatattgggttggtggtctttgtccagaaatatgaagggacaaaggcgggccataaccctcccttctagagtccaggagcttcccctgccactgccacaacccccgatgccaccacagccatcgccactgccacctgcctcccgctgaatcttggctcttgtcttctctttccagcccaggtgaagcctctgggcttcctgaagcccttctccttgatgaaggcttccagccgcttcaaggcacaccaggatgccctgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggggcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctggnggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggtttgacaagacgctgcagttcatcgtggcagaagatggctcctgtgggcttgtgtacgagcatgctgcagcngagggtttccctattgtcacccttctggactatgtcatcgagtacacgaagaaacccgagcttgtgcngtctcccatggtgcccctgcccatgcccaagaagctgcggttcaacatcacccccgagatcaagagcgacatcgagaaggccaagcagaacctcagcatcatgatccannacctggatatcaccgtgatggtgttccaccattttggaaaagacttccccaagtcggagaagctaagcccagatgccttcatccagatggctttgcagctggcctactacaggatctacggacaggcatgtgccacctatgaaagtncntccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccggggctacaccgaccgggccatccgcggggaggcctttggtcgacacctgctgggcctgaagctgcaggccatcgaggacctggtgagcacgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtcccccnnaaatgtactgagccacggaccgcatcctccagggacctgcaggccccagccaagtgccttccgtgggtcatcccagcacctgccagggcccgacctggggctgagtgcagaggctgagcaggacgttaggcccgggcccctggcacgtcctccaccggtgcctcctctgggaaagggaaccaccctccagagcaggagactggcaagagctctttgtctcaccagctcagccccggccactccctgccaactccatgaccaggccaccatctgtaccctgcttcccaaactcccaggcctggagacaggattgtctggggncgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggg

SEQ ID NO: 981 - DNA, 14082 bp, Homo sapiens
atgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtttcttctggtgagtaaaagctgcagataatcaacagccattcagaagaatgataaatgccacaagcatttggaaacaggcttccctaaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccgagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 982 - DNA, 2056 bp, Homo sapiens
gcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttagattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggaacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaaatattccattttcctttccttgtggttgaaaccacagtcagtggagagatgtttggaacacagtcagtggagctggtggtaccaggtttagcattattggatgtcaaaagcattttttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattgtggtaaaa

SEQ ID NO: 983 - DNA, 1536 bp, Homo sapiens
  Modified_base 1100: n = a,c,g, or t
atgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaangatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaa

SEQ ID NO: 984 - DNA, 780 bp, Homo sapiens
gagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctct

SEQ ID NO: 985 - DNA, 1535 bp, Homo sapiens
cctccgctcagtccgggagcgcacgtgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagggcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctt

SEQ ID NO: 986 - DNA, 1262 bp, Homo sapiens
gcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttggtgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagcccccgcatgtggaagatgttcccatcaccgtggagtgaggaaaacagtcagcttgtcctggccaaaggggtttggaaggacaccaagaccccgttggtgactgaagatgacactgagctttaatggctgaagacccagatcagggcagtgaccagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattg

SEQ ID NO: 987 - DNA, 1255 bp, Homo sapiens
ctaaagatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgacgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgactctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatgggagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaatagaaaatatagtttgaggccgggcactgtctggctcacgcctgtaatcccagtacttgggaggccaaggaggcatatcaacttgaggccaggagttaaagagcagcctggctaactgtgaaaccctctctact

(The sequence listing continues in the following parts.)

What is claimed is:

1. A method of assigning treatment to a breast cancer patient, wherein said breast cancer patient is a human breast cancer patient, comprising:

(a) classifying said breast cancer patient as having a prognosis selected from the group consisting of a first prognosis, a second prognosis, and a third prognosis on the basis of a first expression profile comprising the nucleic acid levels of expression of at least five genes listed in Table 5 in a clinically relevant cell sample from said breast cancer patient by a method comprising (a1) determining the similarity between said first expression profile and a first good prognosis expression profile comprising the nucleic acid levels of expression of said at least five genes to obtain a patient similarity value, wherein said nucleic acid levels of expression in said first good prognosis expression profile represent the nucleic acid levels of expression of said genes in patients having no distant metastases within five years of initial diagnosis; and (a2) classifying said breast cancer patient as having said first prognosis if said patient similarity value exceeds a second similarity threshold value, said second prognosis if said patient similarity value exceeds a first similarity threshold value but does not exceed said second similarity threshold value, and said third prognosis if said patient similarity value does not exceed said first similarity threshold value, wherein said second similarity threshold indicates greater similarity to said first good prognosis expression profile than does said first similarity threshold; and (b) assigning said breast cancer patient a treatment without adjuvant chemotherapy if the breast cancer patient is lymph node negative and is classified as having said first prognosis or said second prognosis, or assigning said breast cancer patient a treatment with adjuvant chemotherapy if said breast cancer patient (b1) is lymph node positive and is classified as having said first prognosis, said second prognosis, or said third prognosis, or (b2) is lymph node negative and is classified as having said third prognosis.

2. The method of claim 1, further comprising determining prior to step (a1) said nucleic acid levels of expression of said at least five genes in said clinically relevant cell sample.

3. The method of claim 1, wherein said patient similarity value is a correlation coefficient between said first expression profile and said good prognosis expression profile, and wherein said determining in step (a1) is carried out by a method comprising determining said correlation coefficient.

4. The method of claim 1, wherein said at least five genes are at least 10 genes listed in Table 5.

5. The method of claim 1, wherein said at least five genes are at least 20 genes listed in Table 5.

6. The method of claim 1, wherein said at least five genes are at least 30 genes listed in Table 5.

7. The method of claim 1, wherein said at least five genes are at least 40 genes listed in Table 5.

8. The method of claim 1, wherein said at least five genes are at least 50 genes listed in Table 5.

9. The method of claim 1, wherein said at least five genes are all genes listed in Table 6.

10. The method of claim 1, wherein said first threshold similarity value and said second threshold similarity value are selected by a method comprising:
   (i) rank ordering in descending order a plurality of breast cancer tumor samples, each obtained from a training breast cancer patient of a plurality of training breast cancer patients whose clinical and follow-up data are available for at least five years after initial diagnosis, according to the degree of similarity between a second expression profile comprising the nucleic acid levels of expression of said at least five genes in each of said tumor samples and a second good prognosis expression profile, wherein said second good prognosis expression profile comprises the mean nucleic acid level of expression of each of said at least five genes in tumor samples from training breast cancer patients in said plurality of training breast cancer patients who have no distant metastases within five years of initial diagnosis, to obtain a rank-ordered list, said degree of similarity being expressed as a similarity value;
   (ii) selecting a particular number or percentage of false negatives for classifying said plurality of training breast cancer patients, wherein a false negative is a training breast cancer patient for whom the second expression profile predicts that said training breast cancer patient will have no distant metastases within the first five years after initial diagnosis, but who has had a distant metastasis within five years after initial diagnosis;
   (iii) determining a threshold similarity value, wherein training breast cancer patients from whom tumor samples having a similarity value above said threshold similarity value in said rank ordered list are predicted as having no distant metastases within the first five years after initial diagnosis, and wherein among said training breast cancer patients predicted as having no distant metastases the number or percentage of training breast cancer patients who are false negatives is less than said particular number or percentage selected in said step (ii);
   (iv) selecting said threshold similarity value determined in step (iii) as said first threshold similarity value; and
   (v) selecting a second similarity value by a method comprising determining which of the tumor samples taken from breast cancer patients having a distant metastasis within five years after initial diagnosis in said rank ordered list has the greatest similarity value, and selecting said greatest similarity value as said second threshold similarity value.

11. The method of claim 9, wherein said first expression profile comprises log intensity values for each of the respective genes listed in Table 6, and said first good prognosis profile comprises the mean log intensity values that are listed in Table 7, and wherein said first threshold similarity value is 0.4 and said second threshold similarity value is 0.636.

12. The method of claim 1, wherein said nucleic acid level of expression of each gene of said at least five genes is a relative nucleic acid level of expression of said gene in said cell sample versus the nucleic acid level of expression of said gene in a reference pool.

13. The method of claim 1, wherein said step (a) further comprises before said step (a2):
   (i) rank ordering in descending order a plurality of breast cancer tumor samples, each obtained from a training breast cancer patient of a plurality of training breast cancer patients for whom clinical and follow-up data are available for at least five years after initial diagnosis, according to the degree of similarity between a second expression profile comprising the nucleic acid levels of expression of said at least five genes in each of said tumor samples and a second good prognosis expression profile comprising the mean nucleic acid level of expression of each of said at least five genes in tumor samples from training breast cancer patients in said plurality of training breast cancer patients who have no distant metastases within five years of initial diagnosis, to obtain a rank-ordered list, said degree of similarity being expressed as a similarity value;
   (ii) selecting a particular number or percentage of false negatives for classifying said plurality of training breast cancer patients, wherein a false negative is a training breast cancer patient for whom the second expression profile comprising the nucleic acid levels of said at least five genes predicts that said training breast cancer patient will have no distant metastases within the first five years after initial diagnosis, but who has had a distant metastasis within five years after initial diagnosis;
   (iii) determining a threshold similarity value, wherein training breast cancer patients whose tumor samples having a similarity value above said threshold similarity value in said rank ordered list are predicted as having no distant metastases within the first five years after initial diagnosis, and wherein among said training breast cancer patients predicted as having no distant metastases the number or percentage of training breast cancer patients who are false negatives is less than said particular number or percentage selected in said step (ii);
   (iv) selecting said threshold similarity value determined in step (iii) as said first threshold similarity value; and
   (v) selecting a second similarity value by a method comprising determining which of the tumor samples taken from breast cancer patients having a distant metastasis within five years after initial diagnosis in said rank ordered list has the greatest similarity value, and selecting said greatest similarity value as said second threshold similarity value.

14. A method of assigning a treatment to a breast cancer patient, wherein said breast cancer patient is a human breast cancer patient, comprising:
(a) determining the lymph node status for said breast cancer patient;
(b) determining the nucleic acid levels of expression of at least five genes listed in Table 5 in a clinically relevant cell sample from said breast cancer patient, thereby generating a first expression profile comprising the nucleic acid levels of expression of said at least five genes in said cell sample;
(c) classifying said breast cancer patient as having a prognosis selected from the group consisting of a first prognosis, a second prognosis, and a third prognosis by a method comprising
    (c1) determining the similarity between said first expression profile and a first good prognosis expression profile comprising the nucleic acid levels of expression of said at least five genes to obtain a patient similarity value, wherein said nucleic acid levels of expression in said good prognosis expression profile represent the nucleic acid levels of expression of said genes in breast cancer patients having no distant metastases within five years of initial diagnosis; and
    (c2) classifying said breast cancer patient as having said first prognosis if said patient similarity value exceeds a second similarity threshold value, said second prognosis if said patient similarity value exceeds a first similarity threshold value but does not exceed said second similarity threshold value, and said third prognosis if said patient similarity value does not exceed said first similarity threshold value, wherein said second similarity threshold value indicates greater similarity to said first good prognosis expression profile than does said first similarity threshold value; and
(d) assigning said breast cancer patient a treatment without adjuvant chemotherapy if the breast cancer patient is lymph node negative and is classified as having said first prognosis or said second prognosis, or assigning said breast cancer patient a treatment with adjuvant chemotherapy if said breast cancer patient (d1) is lymph node positive and is classified as having said first prognosis, said second prognosis, or said third prognosis, or (d2) is lymph node negative and is classified as having said third prognosis.

15. The method of claim 14, in which said treatment without adjuvant chemotherapy comprises adjuvant hormonal therapy if said breast cancer patient is lymph node negative and is classified as having said second prognosis.

16. The method of claim 14, wherein said classifying step (c) further comprises before said step (c2):
(i) rank ordering in descending order a plurality of breast cancer tumor samples, each obtained from a different training breast cancer patient of a plurality of training breast cancer patients for whom clinical and follow-up data are available for at least five years after initial diagnosis, according to the degree of similarity between a second expression profile comprising the nucleic acid levels of expression of said at least five genes in each of said tumor samples and a second good prognosis expression profile, said second good prognosis expression profile comprising the nucleic acid levels of expression of said genes that represent the nucleic acid levels of expression of said genes in tumor samples from training breast cancer patients in said plurality of training breast cancer patients who have no distant metastases within five years of initial diagnosis, said degree of similarity being expressed as a similarity value;
(ii) selecting a particular number or percentage of false negatives for classifying said plurality of training breast cancer patients, wherein a false negative is a training breast cancer patient for whom the second expression profile predicts that said training breast cancer patient will have no distant metastases within the first five years after initial diagnosis, but who has had a distant metastasis within the first five years after initial diagnosis;
(iii) determining a threshold similarity value, wherein training breast cancer patients whose tumor samples having a similarity value above said threshold similarity value in said rank ordered list are predicted as having no distant metastases within the first five years after initial diagnosis, and wherein among said training breast cancer patients predicted as having no distant metastases the number or percentage of training breast cancer patients who are false negatives is not greater than said particular number or percentage selected in step (ii);
(iv) selecting said threshold similarity value determined in step (iii) as said first threshold similarity value; and
(v) selecting a second similarity value, greater than said first similarity value, as said second threshold similarity value.

17. The method of claim 14 which further comprises determining the estrogen receptor (ER) status of said breast cancer patient, wherein if said breast cancer patient is ER positive and lymph node negative, said treatment assigned to said breast cancer patient additionally comprises adjuvant hormonal therapy.

18. The method of claim 14, wherein said breast cancer patient is 52 years of age or younger.

19. The method of claim 14 or 18, wherein said breast cancer patient has stage I or stage II breast cancer.

20. The method of claim 14, wherein said breast cancer patient is premenopausal.

21. The method of claim 14, wherein said patient similarity value is a correlation coefficient between said first expression profile and said first good prognosis expression profile, and wherein said determining in step (c1) is carried out by a method comprising determining said correlation coefficient.

22. The method of claim 14, wherein said at least five genes are at least 10 genes listed in Table 5.

23. The method of claim 14, wherein said at least five genes are at least 20 genes listed in Table 5.

24. The method of claim 14, wherein said at least five genes are at least 30 genes listed in Table 5.

25. The method of claim 14, wherein said at least five genes are at least 40 genes listed in Table 5.

26. The method of claim 14, wherein said at least five genes are at least 50 genes listed in Table 5.

27. The method of claim 14, wherein said at least five genes are all genes listed in Table 6.

28. The method of claim 14, wherein said first threshold similarity value and said second threshold similarity value are selected by a method comprising:
(i) rank ordering in descending order a plurality of breast cancer tumor samples, each obtained from a training breast cancer patient of a plurality of training breast cancer patients for whom clinical and follow-up data are available for at least five years after initial diagnosis by the degree of similarity between a second expression profile comprising the nucleic acid levels of expression of said at least five genes in each of said tumor samples and a second good prognosis expression profile, wherein said second good prognosis expression profile comprises the mean nucleic acid level of expression of each of said at least five genes in tumor samples from training breast cancer patients in said plurality of training breast cancer patients who have no distant metastases within five years of initial diagnosis, to obtain a rank-ordered list, said degree of similarity being expressed as a similarity value;

(ii) selecting a particular number or percentage of false negatives for classifying said plurality of training breast cancer patients, wherein a false negative is a training breast cancer patient for whom the second expression profile comprising the nucleic acid levels of said at least five genes in said cell sample predicts that said training breast cancer patient will have no distant metastases within the first five years after initial diagnosis, but who has had a distant metastasis within the first five years after initial diagnosis;

(iii) determining a threshold similarity value, wherein training breast cancer patients whose tumor samples having a similarity value above said threshold similarity value in said rank ordered list are predicted as having no distant metastases within the first five years after initial diagnosis, and wherein among said training breast cancer patients predicted as having no distant metastases the number or percentage of training breast cancer patients who are false negatives is less than said particular number or percentage selected in said step (ii);

(iv) selecting said threshold similarity value determined in step (iii) as said first threshold similarity value; and (v) selecting a second similarity value by a method comprising determining which of the tumor samples taken from breast cancer patients having a distant metastasis within the first five years after initial diagnosis in said rank ordered list has the greatest similarity value, and selecting said greatest similarity value as said second threshold similarity value.

29. The method of claim 27, wherein said first expression profile comprises log intensity values for each of the respective genes listed in Table 6, and said first good prognosis profile comprises the mean log intensity values that are listed in Table 7, and wherein said first threshold similarity value is 0.4 and said second threshold similarity value is 0.636.

30. The method of claim 14, wherein said nucleic acid level of expression of each gene of said at least five genes in said first expression profile is a relative nucleic acid level of expression of said gene in said cell sample versus the nucleic acid level of expression of said gene in a reference pool.

31. The method of claim 12 or 30, wherein said reference pool is derived from a normal breast cell line.

32. The method of claim 12 or 30, wherein said reference pool is derived from a breast cancer cell line.

33. The method of claim 12 or 30, wherein said relative nucleic acid level of expression is represented as a log ratio.

* * * * *